United States Patent 11,446,398 (REGULATED BIOCIRCUIT SYSTEMS) - sequence listing, part 77

SEQ ID NO: 179435 - DNA, 2966 bp, Homo sapiens
  Payload ID: 15360
  Gene Symbol: SFRP4
  Gene Name: secreted frizzled-related protein 4
  Uniprot ID: Q6FHJ7
  ENST ID: ENST00000436072
  CDS Start-End: 379-1419
gggggagcccgcgccgcggctgcagctgccaagggagcgttccgagcccacgtcaggggaggtgtcgggataaatagggtcccgcaatggccgtggctggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcctctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaatctagagaagtagcatatggaaaactataatgtgtcttttttacaatgacttcagctctgtttttagctagaaactctaaaaacaaaaataataataaagaaaaataaataaaaaggagaggcagacaatgtctggattcctgttttttggttacctgatttcatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcattcaataaatgcacaacgcccaaaggaaataaaatcctatctaatcctactctccactacacagaggtaatcactattagtattttggcatattattctccaggtgtttcttatgcacttataaaatgatttgaacaaataaaactaggaacctgctatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaatagtcaaa

SEQ ID NO: 179436 - DNA, 1836 bp, Homo sapiens
  Payload ID: 15361
  Gene Symbol: SFRP5
  Gene Name: secreted frizzled-related protein 5
  Uniprot ID: Q5T4F7
  ENST ID: ENST00000266066
  CDS Start-End: 120-1073
gcggcggcggcggcggcggctgggtagagtcagggccgggggcgcacgccggaacacctgggccgccgggcaccgagcgtcggggggctgcgcggcgcgcacctggagagggcgcagccatgcgggcggcggcggcgggggggggcgtgcggacggccgcgctggcgctgctgctgggggcgctgcactgggcgccggcgcgctgcgaggagtacgactactatggctggcaggccgagccgctgcacggccgctcctactccaagccgccgcagtgccttgacatccctgccgacctgccgctctgccacacggtgggctacaagcgcatgcggctgcccaacctgctggagcacgagagcctggccgaagtgaagcagcaggcgagcagctggctgccgctgctggccaagcgctgccactcggatacgcaggtcttcctgtgctcgctctttgcgcccgtctgtctcgaccggcccatctacccgtgccgctcgctgtgcgaggccgtgcgcgccggctgcgcgccgctcatggaggcctacggcttcccctggcctgagatgctgcactgccacaagttccccctggacaacgacctctgcatcgccgtgcagttcgggcacctgcccgccaccgcgcctccagtgaccaagatctgcgcccagtgtgagatggagcacagtgctgacggcctcatggagcagatgtgctccagtgactttgtggtcaaaatgcgcatcaaggagatcaagatagagaatggggaccggaagctgattggagcccagaaaaagaagaagctgctcaagccgggccccctgaagcgcaaggacaccaagcggctggtgctgcacatgaagaatggcgcgggctgcccctgcccacagctggacagcctggcgggcagcttcctggtcatgggccgcaaagtggatggacagctgctgctcatggccgtctaccgctgggacaagaagaataaggagatgaagtttgcagtcaaattcatgttctcctacccctgctccctctactaccctttcttctacggggcggcagagccccactgaagggcactcctccttgccctgccagctgtgccttgcttgccctctggccccgccccaacttccaggctgacccggccctactggagggtgttttcacgaatgttgttactggcacaaggcctaagggatgggcacggagcccaggctgtcctttttgacccaggggtcctggggtccctgggatgttgggcttcctctctcaggagcagggcttcttcatctgggtgaagacctcagggtctcagaaagtaggcaggggaggagagggtaagggaaaggtggaggggctcagggcaccctgaggcggaggtttcagagtagaaggtggtgtcagctccagctcccctctgtcggtggtggggcctcaccttgaagagggaagtctcaatattaggctaagctatttgggaaagttctccccaccgcccctgtacgcgtcatcctagccccccttaggaaaggagttagggtctcagtgcctccagccacaccccctgccttccccagcttgcccatttccctgccccaaggcccagagctccccccagactggagagcaagcccagcccagcctcggcatagacccccttctggtccgcccgcggctcgattcccgggattcattcctcagcctctgcttctcccttttatcccaataagttattgctactgctgtgaggccataggtactagacaaccaatacatgcagggttgggttttctaatttttttaactttttaattaaatcaaagaaaacaataa

SEQ ID NO: 179437 - DNA, 537 bp, Homo sapiens
  Payload ID: 15362
  Gene Symbol: SLURP1
  Gene Name: secreted LY6/PLAUR domain containing 1
  Uniprot ID: P55000
  ENST ID: ENST00000246515
  CDS Start-End: 27-338
ctctcatcacttctgagcacggagcaatggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaagagtgga

SEQ ID NO: 179438 - DNA, 1581 bp, Homo sapiens
  Payload ID: 15363
  Gene Symbol: SPP1
  Gene Name: secreted phosphoprotein 1
  Uniprot ID: P10451
  ENST ID: ENST00000237623
  CDS Start-End: 149-1051
ggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcctatataatgtttttaaa

SEQ ID NO: 179439 - DNA, 1196 bp, Homo sapiens
  Payload ID: 15363
  Gene Symbol: SPP1
  Gene Name: secreted phosphoprotein 1
  Uniprot ID: P10451
  ENST ID: ENST00000360804
  CDS Start-End: 102-965
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaaga

SEQ ID NO: 179440 - DNA, 1473 bp, Homo sapiens
  Payload ID: 15363
  Gene Symbol: SPP1
  Gene Name: secreted phosphoprotein 1
  Uniprot ID: P10451
  ENST ID: ENST00000395080
  CDS Start-End: 128-1072
aattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgt

SEQ ID NO: 179441 - DNA, 825 bp, Homo sapiens
  Payload ID: 15363
  Gene Symbol: SPP1
  Gene Name: secreted phosphoprotein 1
  ENST ID: ENST00000508233
  CDS Start-End: 102-825
agcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagacccttccaagtaagtccaacgaaagccatgaccacatggatgatatggatgatgaagatgatgatgaccatgtggacagccaggactccattgactcgaacgactctgatgatgtagatgacactgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaag

SEQ ID NO: 179442 - DNA, 1558 bp, Homo sapiens
  Payload ID: 15363
  Gene Symbol: SPP1
  Gene Name: secreted phosphoprotein 1
  Uniprot ID: P10451
  ENST ID: ENST00000614857
  CDS Start-End: 166-1044
ctccctgtgttggtggaggatgtctgcagcagcatttaaattctgggagggcttggttgtcagcagcagcaggaggaggcagagcacagcatcgtcgggaccagactcgtctcaggccagttgcagccttctcagccaaacgccgaccaaggaaaactcactaccatgagaattgcagtgatttgcttttgcctcctaggcatcacctgtgccataccagttaaacaggctgattctggaagttctgaggaaaagcagctttacaacaaatacccagatgctgtggccacatggctaaaccctgacccatctcagaagcagaatctcctagccccacagaatgctgtgtcctctgaagaaaccaatgactttaaacaagagacccttccaagtaagtccaacgaaagccatgaccacatggatgatatggatgatgaagatgatgattctcaccagtctgatgagtctcaccattctgatgaatctgatgaactggtcactgattttcccacggacctgccagcaaccgaagttttcactccagttgtccccacagtagacacatatgatggccgaggtgatagtgtggtttatggactgaggtcaaaatctaagaagtttcgcagacctgacatccagtaccctgatgctacagacgaggacatcacctcacacatggaaagcgaggagttgaatggtgcatacaaggccatccccgttgcccaggacctgaacgcgccttctgattgggacagccgtgggaaggacagttatgaaacgagtcagctggatgaccagagtgctgaaacccacagccacaagcagtccagattatataagcggaaagccaatgatgagagcaatgagcattccgatgtgattgatagtcaggaactttccaaagtcagccgtgaattccacagccatgaatttcacagccatgaagatatgctggttgtagaccccaaaagtaaggaagaagataaacacctgaaatttcgtatttctcatgaattagatagtgcatcttctgaggtcaattaaaaggagaaaaaatacaatttctcactttgcatttagtcaaaagaaaaaatgctttatagcaaaatgaaagagaacatgaaatgcttctttctcagtttattggttgaatgtgtatctatttgagtctggaaataactaatgtgtttgataattagtttagtttgtggcttcatggaaactccctgtaaactaaaagcttcagggttatgtctatgttcattctatagaagaaatgcaaactatcactgtattttaatatttgttattctctcatgaatagaaatttatgtagaagcaaacaaaatacttttacccacttaaaaagagaatataacattttatgtcactataatcttttgttttttaagttagtgtatattttgttgtgattatctttttgtggtgtgaataaatcttttatcttgaatgtaataagaatttggtggtgtcaattgcttatttgttttcccacggttgtccagcaattaataaaacataaccttttttactgcct

SEQ ID NO: 179443 - DNA, 1024 bp, Homo sapiens
  Payload ID: 15364
  Gene Symbol: SPP2
  Gene Name: secreted phosphoprotein 2, 24kDa
  Uniprot ID: Q13103
  ENST ID: ENST00000168148
  CDS Start-End: 89-724
gccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgaggtgtccctcgcccttttggtttgttcaaggagctgctgctttgcatagctgctctagtgtctggtatcatcggatctggttttgaataattcccaggagtcctgggtccctggcctccaaagctggaatgtgaacgcatgccacggtggtctgaccctcacactccttttctcttaacagcaaaatgcaatggaaggaagaaaagttccaacaaagaatgattttgtgaattctgtgatttttcttctgatcagtttcaatctgtaataaatgccttatttttcctgtaa

SEQ ID NO: 179444 - DNA, 860 bp, Homo sapiens
  Payload ID: 15364
  Gene Symbol: SPP2
  Gene Name: secreted phosphoprotein 2, 24kDa
  Uniprot ID: Q13103
  ENST ID: ENST00000373368
  CDS Start-End: 109-744
tgctgcagtcaaaataagcagccagtgtttgataaagacagctcctcttaggaagaactgtcatccccaaacacatagagagacactctctgtctctcgattacaatcatgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgagcaaaatgcaatggaaggaagaaaagttccaacaaagaatgattttgtgaattctgtgatttttcttctgatcagtttcaatctgtaataaatgccttatttttcct

SEQ ID NO: 179445 - DNA, 508 bp, Homo sapiens
  Payload ID: 15364
  Gene Symbol: SPP2
  Gene Name: secreted phosphoprotein 2, 24kDa
  ENST ID: ENST00000425558
  CDS Start-End: 116-508
atgatttccagaatggagaagatgacgatgatgatgaagatattgattatgtttgctcttggaatgaactactggtcttgctcaggttgaggtcctagatgagaacaacttggtcatgaatttagagttcagcatccgggagactacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgag

SEQ ID NO: 179446 - DNA, 3701 bp, Homo sapiens
  Payload ID: 15365
  Gene Symbol: SPARC
  Gene Name: secreted protein, acidic, cysteine-rich (osteonectin)
  Uniprot ID: P09486
  ENST ID: ENST00000231061
  CDS Start-End: 315-1226
taggcagcagccccggaacagatgaggcaggcagggttgggacgtttggtcaggacagcccaccgcaaaaagaggaggaaagaaatgaaagacagagacagctttggctatgggagaaggaggaggccgggggaaggaggagacaggaggaggagggaccacggggtggaggggagatagacccagcccagagctctgagtggtttcctgttgcctgtctctaaacccctccacattcccgcggtccttcagactgcccggagagcgcgctctgcctgccgcctgcctgcctgccactgagggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagcaccccattgacgggtacctctcccacaccgagctggctccactgcgtgctcccctcatccccatggagcattgcaccacccgctttttcgagacctgtgacctggacaatgacaagtacatcgccctggatgagtgggccggctgcttcggcatcaagcagaaggatatcgacaaggatcttgtgatctaaatccactccttccacagtaccggattctctctttaaccctccccttcgtgtttcccccaatgtttaaaatgtttggatggtttgttgttctgcctggagacaaggtgctaacatagatttaagtgaatacattaacggtgctaaaaatgaaaattctaacccaagacatgacattcttagctgtaacttaactattaaggccttttccacacgcattaatagtcccatttttctcttgccatttgtagctttgcccattgtcttattggcacatgggtggacacggatctgctgggctctgccttaaacacacattgcagcttcaacttttctctttagtgttctgtttgaaactaatacttaccgagtcagactttgtgttcatttcatttcagggtcttggctgcctgtgggcttccccaggtggcctggaggtgggcaaagggaagtaacagacacacgatgttgtcaaggatggttttgggactagaggctcagtggtgggagagatccctgcagaacccaccaaccagaacgtggtttgcctgaggctgtaactgagagaaagattctggggctgtgttatgaaaatatagacattctcacataagcccagttcatcaccatttcctcctttacctttcagtgcagtttcttttcacattaggctgttggttcaaacttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttcttctattaatcaagagaaacttcaaagttaatgggatggtcggatctcacaggctgagaactcgttcacctccaagcatttcatgaaaaagctgcttcttattaatcatacaaactctcaccatgatgtgaagagtttcacaaatccttcaaaataaaaagtaatgacttagaaactgccttcctgggtgatttgcatgtgtcttagtcttagtcaccttattatcctgacacaaaaacacatgagcatacatgtctacacatgactacacaaatgcaaacctttgcaaacacattatgcttttgcacacacacacctgtacacacacaccggcatgtttatacacagggagtgtatggttcctgtaagcactaagttagctgttttcatttaatgacctgtggtttaacccttttgatcactaccaccattatcagcaccagactgagcagctatatccttttattaatcatggtcattcattcattcattcattcacaaaatatttatgatgtatttactctgcaccaggtcccatgccaagcactggggacacagttatggcaaagtagacaaagcatttgttcatttggagcttagagtccaggaggaatacattagataatgacacaatcaaatataaattgcaagatgtcacaggtgtgatgaagggagagtaggagagaccatgagtatgtgtaacaggaggacacagcattattctagtgctgtactgttccgtacggcagccactacccacatgtaactttttaagatttaaatttaaattagttaacattcaaaacgcagctccccaatcacactagcaacatttcaagtgcttgagagccatgcatgattagtggttaccctattgaataggtcagaagtagaatcttttcatcatcacagaaagttctattggacagtgctcttctagatcatcataagactacagagcacttttcaaagctcatgcatgttcatcatgttagtgtcgtattttgagctggggttttgagactccccttagagatagagaaacagacccaagaaatgtgctcaattgcaatgggccacatacctagatctccagatgtcatttcccctctcttattttaagttatgttaagattactaaaacaataaaagctcctaaaaaatcaaactgtattctggtgttctcttctacacagtgggagggcgagcagtaggagagattggcccatttggtgctggccatttgaggaatgcaagcccagcactagtctcataatctctaggaatctgtagagagaggaattgaagtaaatttcagcattggctcattcagtcattcggcgacattcatcaggtacctgcaatgtgttaggggatcttatgagtaggcagcgtgcgtgatccttgctcccctggagctttctaacattctagcaggcagaccacacataaatttgcaatactgtttctgataaaaacgtgctgtaaaggaaataaagcagagaactatcatggaaaa

SEQ ID NO: 179447 - DNA, 602 bp, Homo sapiens
  Payload ID: 15365
  Gene Symbol: SPARC
  Gene Name: secreted protein, acidic, cysteine-rich (osteonectin)
  ENST ID: ENST00000521569
  CDS Start-End: 258-602
gagtggtttcctgttgcctgtctctaaacccctccacattcccgcggtccttcagactgcccggagagcgcgctctgcctgccgcctgcctgcctgccactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctg

SEQ ID NO: 179448 - DNA, 497 bp, Homo sapiens
  Payload ID: 15365
  Gene Symbol: SPARC
  Gene Name: secreted protein, acidic, cysteine-rich (osteonectin)
  ENST ID: ENST00000522348
  CDS Start-End: 339-497
gtttcctgttgcctgtctctaaacccctccacattcccgcggtccttcagactgcccggagagcgcgctctgcctgccgcctgcctgcctgccactgaggccttggtcttctcatctgtactattgggcagaaatatgtgacttgagcccccagtggggtgctggattatgaaaacaccctgaaaatgataaatgtatgcatcatcacagactaaagaaatacaaaggagggagtttttgtttaatattggtcatttatatgaagggaatttaaattttcgccaggcacgctacacctaggtttgattggcaaaggatcacagctggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtagga

SEQ ID NO: 179449 - DNA, 576 bp, Homo sapiens
  Payload ID: 15365
  Gene Symbol: SPARC
  Gene Name: secreted protein, acidic, cysteine-rich (osteonectin)
  ENST ID: ENST00000538026
  CDS Start-End: 128-576
gtttcctgttgcctgtctctaaacccctccacattcccgcggtccttcagactgcccggagaatccctgccagaaccaccactgcaaacacggcaaggtgtgcgagctggatgagaacaacacccccatgtgcgtgtgccaggaccccaccagctgcccagcccccattggcgagtttgagaaggtgtgcagcaatgacaacaagaccttcgactcttcctgccacttctttgccacaaagtgcaccctggagggcaccaagaagggccacaagctccacctggactacatcgggccttgcaaatacatccccccttgcctggactctgagctgaccgaattccccctgcgcatgcgggactggctcaagaacgtcctggtcaccctgtatgagagggatgaggacaacaaccttctgactgagaagcagaagctgcgggtgaagaagatccatgagaatgagaagcgcctggaggcaggagaccaccccgtggagctgctggcccgggacttcgagaagaactataacatgtacatcttccctgtacactggcagttcggccagctggaccagca

SEQ ID NO: 179450 - DNA, 511 bp, Homo sapiens
  Payload ID: 15365
  Gene Symbol: SPARC
  Gene Name: secreted protein, acidic, cysteine-rich (osteonectin)
  ENST ID: ENST00000539687
  CDS Start-End: 179-511
agctatcagctgccacatcgacatagcctagagcaaagagggggagggaggagaagaagggggttgcctggagaaggaatcaacttttgaaactttctccaagtcccacccaccagaaggctcttctctgcctgactcactctccgaggaatgcgagttgccacgggttcccagcaccatgagggcctggatcttctttctcctttgcctggccgggagggccttggcagcccctcagcaagaagccctgcctgatgagacagaggtggtggaagaaactgtggcagaggtgactgaggtatctgtgggagctaatcctgtccaggtggaagtaggagaatttgatgatggtgcagaggaaaccgaagaggaggtggtggcggaaaatccctgccagaaccaccactgcaaacacggcaaggtgtgcgagctggatgagaacaacacccccatgtgcgtgtgccaggaccccaccagctgcccagcccccattggcgagtttgagaaggtg

SEQ ID NO: 179451 - DNA, 366 bp, Homo sapiens
  Payload ID: 15366
  Gene Symbol: SCT
  Gene Name: secretin
  Uniprot ID: P09683
  ENST ID: ENST00000176195
  CDS Start-End: 1-366
atggccccccggcccctcctgctgctgctgctgctcctcgggggctccgccgcgcgccccgcgccccccagggcccggcgacactcagacgggacgttcaccagcgagctcagccgcctgcgggagggcgcgcggctccagcggctgctacagggcctggtggggaagcgcagcgagcaggacgcagagaacagcatggcctggaccaggctcagcgcgggtctgctctgcccgtcagggtccaacatgcccatcctgcaggcctggatgcccctggacgggacctggtctccctggctgccccctgggcctatggtttcagaaccagctggcgctgctgcagaaggaaccttgcggcccagatga

SEQ ID NO: 179452 - DNA, 366 bp, Homo sapiens; identical to SEQ ID NO: 179451
  Payload ID: 15366
  Gene Symbol: SCT
  Gene Name: secretin
  Uniprot ID: P09683
  ENST ID: ENST00000622382
  CDS Start-End: 1-366

SEQ ID NO: 179453 - DNA, 1865 bp, Homo sapiens
  Payload ID: 15367
  Gene Symbol: SCTR
  Gene Name: secretin receptor
  Uniprot ID: P47872
  ENST ID: ENST00000019103
  CDS Start-End: 269-1591
gaccccgcgccagtccctgccgggtggaggaggcgcgccggcaaagccgcgtcctgatcaatggggcgggcggcttagcgcgcgcggccacctggtccgaggaggagcagtcccggggcccgccgcaggtcgggtggctcagccatggctcctcggggcgcagcggccggccggagcccgggaccctgcgcggggcgctgagctcccgagcgggcagagggcacgggcaggcggacgtcggggcgccctcggggaacgtgcgggcaccatgcgtccccacctgtcgccgccgctgcagcagctactactgccggtgctgctcgcctgcgccgcgcactcgactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtcatggtgctgttccagtactgcatcatggccaactactcctggctgctggtggaaggcctctaccttcacacactcctcgccatctccttcttctctgaaagaaagtacctccagggatttgtggcattcggatggggttctccagccatttttgttgctttgtgggctattgccagacactttctggaagatgttgggtgctgggacatcaatgccaacgcatccatctggtggatcattcgtggtcctgtgatcctctccatcctgattaatttcatccttttcataaacattctaagaatcctgatgagaaaacttagaacccaagaaacaagaggaaatgaagtcagccattataagcgcctggccaggtccactctcctgctgatccccctctttggcatccactacatcgtcttcgccttctccccagaggacgctatggagatccagctgttttttgaactagcccttggctcattccagggactggtggtggccgtcctctactgcttcctcaatggggaggtgcagctggaggttcagaagaagtggcagcaatggcacctccgtgagttcccactgcaccccgtggcctccttcagcaacagcaccaaggccagccacttggagcagagccagggcacctgcaggaccagcatcatctgagaggctggagcagggtcacccacggacagagaccaagagaggtcctgcgaaggctgggcactgctgtgggacagccagtcttcccagcagacaccctgtgtcctccttcagctgaagatgcccctccccaggccttggactcttccgaagggatgtgaggcactgtggggcaggacaagggcctgggatttggttcgtttgctcttctgggaagagaagttcaggggtcccagaaagggacagggaaataaatggtgcctgggatgagattcaa

SEQ ID NO: 179454 - DNA, 920 bp, Homo sapiens
  Payload ID: 15367
  Gene Symbol: SCTR
  Gene Name: secretin receptor
  ENST ID: ENST00000630739
  CDS Start-End: 471-920
ggatacacagcaccgatggagagggctactgggactacctgcctgaggcttaaatagcctcccagggggttcatcctcaggacggtccccagatgcctgagtgtaccacagatcctccttggtcatcatcaaaggaggagttcatgggagtgaaacttcatggaattagcgctaatgacttcaataatgaaaaaatcggaaataaagtgcaagactggagcccttccccgactatgtgacgtgctacaagtgctgtgggaagagcaagaccagtgcctgcaggaactctccagagagcagacaggagacctgggcacggagcagccagtgccagctcatttctagccccttccaagcctgaccccagcgatgacctctcagagggcacgggttccagaagtctgttgcaggaagcagtttccctgtgtggctgcccttggatcaactttgggagaattggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtc

SEQ ID NO: 179455 - DNA, 770 bp, Homo sapiens
  Payload ID: 15367
  Gene Symbol: SCTR
  Gene Name: secretin receptor
  ENST ID: ENST00000627145
  CDS Start-End: 42-770
ttgagtttgcaagacccatctagtgctgggcccagtggctcatgcctgtaatcccagcactttgggaggccgaggtgagaggatctcttgagcccaagagttcaagaccagcctgggcaacatgggtcttctctccctgctccattatgttggaatttccagagactatgggcttcagcaagaaccagactggagcccttccccgactatgtgacgtgctacaagtgctgtgggaagagcaagaccagtgcctgcaggaactctccagagagcagacaggagacctgggcacggagcagccagtgccaggttgtgaggggatgtgggacaacataagctgctggccctcttctgtgccgggccggatggtggaggtggaatgcccgagattcctccggatgctcaccagcagaaatggttccttgttccgaaactgcacacaggatggctggtcagaaaccttccccaggcctaatctggcctgtggcgttaatgtgaacgactcttccaacgagaagcggcactcctacctgctgaagctgaaagtcatgtacaccgtgggctacagctcctccctggtcatgctcctggtcgcccttggcatcctctgtgctttccggaggctccactgcactcgcaactacatccacatgcacctgttcgtgtccttcatccttcgtgccctgtccaacttcatcaaggacgccgtgctcttctcctcagatgatgtcacctactgcgatgcccacagggcgggctgcaagctggtc

SEQ ID NO: 179456 - DNA, 437 bp, Homo sapiens
  Payload ID: 15368
  Gene Symbol: SAR1A
  Gene Name: secretion associated, Ras related GTPase 1A
  ENST ID: ENST00000373236
  CDS Start-End: 1-366
atgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgtatgttttgtcctttaatgtgtattttaatgtatattttgttcttttttggcctctatttttttttaaggaatatagctcagtagtgc

SEQ ID NO: 179457 - DNA, 3227 bp, Homo sapiens
  Payload ID: 15368
  Gene Symbol: SAR1A
  Gene Name: secretion associated, Ras related GTPase 1A
  Uniprot ID: Q9NR31
  ENST ID: ENST00000373238
  CDS Start-End: 359-955
cctgttactttcacttggagaatagggaggcttggggtgggggcaggactgtggaggaagtcaagtttgctgtcttctatggttgtggtttgtggcacaacaaaacaattatactagtaataccaaagatcactgatcatagatcatgatgacagatataagaataatgaaaaagtttgaaatattgtgtgagaattaccaaaatgtaacatagagacatgaagggagcacatgctgttagaagatggtactgatacacttactcaactcagggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 179458 - DNA, 468 bp, Homo sapiens
  Payload ID: 15368
  Gene Symbol: SAR1A
  Gene Name: secretion associated, Ras related GTPase 1A
  ENST ID: ENST00000373239
  CDS Start-End: 317-468
acatccggcgagtagctggcggtcccgggtgctgctggttagtgtgctctgagggagggtccgagccagccgctgttttgccggaggagcccctcaggccgttcaagcgtttctcctgcctcagccttctgcatagctgggattacaagcaagcgctgccgcgcccagctgttcattttattcttcatctggcattctttgaatagatgcaggtctctctatgttacccaggctggtcttgaactcctgaggtcagggaggaatcccccacctcagccttgcaaaatgctgggattacaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattggg

SEQ ID NO: 179459 - DNA, 2996 bp, Homo sapiens
  Payload ID: 15368
  Gene Symbol: SAR1A
  Gene Name: secretion associated, Ras related GTPase 1A
  Uniprot ID: Q9NR31
  ENST ID: ENST00000373241
  CDS Start-End: 128-724
gggtgtgacgtacatccggcgagtagctggcggtcccgggtgctgctggttagtgtgctctgagggagggtccgagccagccgctgttttgccggaggagcccctcaggccgtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaa

SEQ ID NO: 179460 - DNA, 5981 bp, Homo sapiens
  Payload ID: 15368
  Gene Symbol: SAR1A
  Gene Name: secretion associated, Ras related GTPase 1A
  Uniprot ID: Q9NR31
  ENST ID: ENST00000373242
  CDS Start-End: 198-794
gggtgtgacgtacatccggcgagtagctggcggtcccgggtgctgctggttagtgtgctctgagggagggtccgagccagccgctgttttgccggaggagcccctcaggccggctgcttccaaccttcaatttgtaaaaaaaccagaaaacctcaggatccacaaagtatcatcaaatgaggtagtaagcattaataatgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcagtgggctttaaaatttccatttgcagaatttggtctctcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcattttaataaaaagttaaaacaaatacgctatttccttttttttttttcattggtttgttctgagctctgagtttgaacaatgccgtttatttggggaggcaaccaaaagttccctgcatagaggaagagacatttagggtgcgtgtgagatacttgaattttgccaccaggagggggaaaaaggctggggtactagaagtaatagatttagtactacttgagagatttggaacatgctgtggacccagggttgttggtcatctctgcaacaggatggggatggcagatgtttgagcaaaatctatattaacatgctagcaaggactagttctagtttagctgtgtttcactcattttacacagaattagaattggccaggtgtggtggctcacgctgtaatcctagcactttgggaggctgaggtgggtggattgtctgagctcaggagtttgagaccagcctggggaacagggtgaaaccccatcactactaaaatacaaaaaaattagctgggcattgtggtacatggagtagctcccagctactctggaggctgaggcggagaatcgcttgaactaggaggtggagattgaagtgagccgagatcatgccactgtactcctgcctgggtgacagagcaagactctctctagctcaaaaaaaaaaaaaaaaaaaaaatcaattaaatgctacatttggcaaaatgagaaagaaagaatttcctttactaggcttgtaggaagactgcttttacaaaaacccaaatgagatcataaaactaaagtactgggacaaacagtgggaaacagtgcaatgggttcttttcaaccaagtattaaagtattggagatattgccgggcgcggtggctcacgtctgtaatcctagcgctttgggaggccaaggcgggcgggtcatgaggtcaggagttcaaggccagcctgaccaacatggcagagctccgtctctactaaaaatacaaaaattagccaggcacggtgggacgcacctttaatcccagctactcaggaggctgaagcaggagaatcgcttgaatcggggaagcggaggttgcagtgagccgagatcgcgccactgcactccagcctgggtgactcccatctcaaaaaaaataaaaagtactggaggtgtcctgttgtccttgttactgtgaaaggatgccatgggttgtatgggcaaatgagttgttttgtttgaggcagagtggaaaataagattaggctcagtccatgagcctagcactcaacagatcttactttggcgttctggctgtgacttgggacttctttttaccatggtctgctgtaaacacagaaaaacccaatgcctaacagttcatgctggagtcttgagcgttgagggagaatcactggactcgagagagaaagtttgtttgtttgtttgtttgtttgttttttgagttggtctcactctgtcgcccaggctggagtgcagtggtatgaacataggtcactgcagccttgacctcctgggcttaagtgatcctcccatctcagcctcccaagtagcttgggaccacagggttgcaccaccgtgctcagctagttttcaaaatttttgtagagttaaggtctcatcatgttgcccaggctggtctcaaactcctgggctcaggaaattctcctacctcagcctcccaacgtgctgggattccaagtgtgagcccctgtgctccaccaagagaaaaactctttgattgctaggaagttgggataaagaaattgtgctgtgatcaagccaccttctgtgtcatagaaccaaaagaagaccgcctgctatggcaagatggcctaattttattcctgcctcatactatcatggataatcgttttcctttctctagcaggtttgtgtcactgggagtactgggagcattatcctgtgttgtgctggggttataccaagcagtgttaactttatttaaagaattcaggcagaaagattagagaatttaagtagcaattgtatatggtaagcaatacagtaaccttaataaaaattaatgatggccgggtacggtggctcacgcctgtaatcccagcactttgggaggccgaggcgggcggatcacaaggtcaggagatcgagaccatcctggctaacacggtgaaaccccgtctctactaaaaatacaaaaaattagctgggcgtggtggcaggcgcctgtagtcccagcgactggggaggctgaggcaggagaatagcgtgaacccaggaggcggagtttgcagtgagcggagatcgcaccattgcactccagcctgggcgacagagcgagactccgtctcaaaaaaataaataaataaataaaaaataatgtgtattttatcaattcagtgataaagcagacctttgtaaactgtctagcttgtggtgactgattgagggtatcatgaagctccgcgcccccccactccccgacatactcgttcatcctcctctgtcctaaagcgtacttctttggaaaagtagagcagtttatgttagtgtacactagagatggtaaactatgccttgtgggtcaaatcgggcctgctgcctgtgtttgtatggcctgtgagcaaagaaaggtttttacatatttaaatggttggaaaaaatatttaaagaatgctatttttggacacaaaaaattgtatgaaattaaaatttcaatgtctgtatctttttattgggacacagccaccgccattcctttagcttttgtatgcaacagctgcagagttgactatttgagacaagttgtatggtccccccaaactggaactgtttccattctggccttctacagaaagtatttggaccctggcctagataaatcctggctggtggttatgttatgtgaaatgtgcacactgtaaaatataggcctgtatgattaaaatttttgatttca

SEQ ID NO: 179461 - DNA, 672 bp, Homo sapiens
  Payload ID: 15368
  Gene Symbol: SAR1A
  Gene Name: secretion associated, Ras related GTPase 1A
  ENST ID: ENST00000452767
  CDS Start-End: 1-346
gtctttctggtggactgtgcagatcattctcgcctcgtggaatccaaagttgagcttaatgatatattgcagctcacttctcacactggcccctaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaa

SEQ ID NO: 179462 - DNA, 2810 bp, Homo sapiens
  Payload ID: 15368
  Gene Symbol: SAR1A
  Gene Name: secretion associated, Ras related GTPase 1A
  Uniprot ID: Q9NR31
  ENST ID: ENST00000431664
  CDS Start-End: 1-597
atgtctttcatctttgagtggatctacaatggcttcagcagtgtgctccagttcctaggactgtacaagaaatctggaaaacttgtattcttaggtttggataatgcaggcaaaaccactcttcttcacatgctcaaagatgacagattgggccaacatgttccaacactacatccgacatcagaagagctaacaattgctggaatgacctttacaacttttgatcttggtgggcacgagcaagcacgtcgcgtttggaaaaattatctcccagcaattaatgggattgtctttctggtggactgtgcagatcattctcgcctcgtggaatccaaagttgagcttaatgctttaatgactgatgaaacaatatccaatgtgccaatccttatcttgggtaacaaaattgacagaacagatgcaatcagtgaagaaaaactccgtgagatatttgggctttatggacagaccacaggaaaggggaatgtgaccctgaaggagctgaatgctcgccccatggaagtgttcatgtgcagtgtgctcaagaggcaaggttacggcgagggtttccgctggctctcccagtatattgactgatgtttggacggtgaaaataaaagagttttacttctctggactgatcctattcacagcttcctcatgaacttttctaatagaacaaggaaagctctccaaccatgtctggcgttgagaagccaagagtctctgtcaactctctcattgcccagtggtgacatgtgctcttctccacactgttgggaggtaatgctgccccacgtgctggtgcaggtcagtatcctgggacttggaagctggcaggatttgccgggtaaagctgtatgccatcatggggcacctgaaaagaaaaacacgtctcaccactgtggttgattcaaaagaaagtgattctattttttaaagaaagcgttgttaatgtaattggtatccctcctaactttttgagttcacaatttacttggtccagagttttctattcttttttttttttaaactaatgaatgacatttagatacttcataaaattatgaacagatatggaggccagagctcatttgggtaaacttactcctgctgagttagcaggttggtgagagaagctcccctgagctcacctgtctctctgactgccttggagtaggtggcataaccttgtgcacagagaactagaaaaggggcagaaccccggccttgcagttgtggcaggtttccactgtggtaagctaggttcattcctcatcaaggaatgtgtagcagattgttcactgtggaggagttaattatagaatgggttattgttgttattcttactcatgaagttacagattttagccagtctttgcttttatacttttgtgaaatttaatttctctctatagcaccttcctttttcgttttcagttatcaaaagtgactttgacctcataaaagagttgagaacatctctcgtgtcacatactgcaggtgcatcagttacttttgcacagattctagggggacatttttctgaataggaagacaggacaaagttaacagcttaagggctcttaattctgtgagttgaggacttaaaagtattgtagcatttgtttggatccatgaaaaatgtattcaggctgtttgggagctcttttttttacattttttctcctttgacacctattttattggtgtttaaagtaaaggttaacatctgtagcttttccaggtttttttttttttttttttttttttggtatgaaattgtctttctccattgcagaaataagctagggaaacactaacccaaaaactttctgtagagctgttcctttggaggcagcatcacttattggcagtaaagactcagtataaaagcaccggcatccctacttgggtgatggggattaattttatagcattccattttcctagtgccacatgtgaaattggattttgatgatcttaatctatattctacccttataataaaagatcaaaagatatatctcctatgaacagattggagataggagatgaaaagttgggaggatgtctttattctaatgtgagggtagggaaaatgtggataacattactggggtgagggaggcattgttctttagttggagttctcattcttattctccagtactgacttgtggggaaagcatactttttcactgccaggtactgaatgcagaggctcagtgaagtatatatgtgggaagtgcatgcatttcgtttattagcaaacatagctggattaagacaaagttgttggtttggaaaggggttaaagccttaagtgaacaaatctagctaacagtgaatgaactaggtaatataacttgcatatttttaatttcctttggttaaaggtcccccatacttctctgttcggagacatgagaagtatgattacttcagtgttagttttcttaattttttttttcccctatttgtcccttgtcactttgttgcaagctagaaatctgtgggttatacatagggcagctctttgtgaaagtggtttattccactggagaaaggggattgaaaatcagttagaaccaatgtatttcttgccccacggaacactattcctataagatagctgaaagaagctgctgtgaggagctcagctccaaacacaggatcagcaccttgtataggaattcccatgaattatgacttctcattctgttttatcagagtgcatatatgtcctacttcaggaaaagtaaaacagtcatttacgaaagaaagtcaatctgtatcctaagcatttt

SEQ ID NO: 179463 - DNA, 6682 bp, Homo sapiens
  Payload ID: 15369
  Gene Symbol: SAR1B
  Gene Name: secretion associated, Ras related GTPase 1B
  Uniprot ID: Q9Y6B6
  ENST ID: ENST00000402673
  CDS Start-End: 280-876
gagaccaggcggctgggagacccaggcggtgttaggggttgcgagcagcctcgctcaactggggaattggcggcaagactgccaggaggcggaacctagggcgctcggcgacgcggtcctgcggactgtcgctagtgaggcacccgccggcccggaaggggctgatgcgaactggggccacggcagccatcgcgctttgcagttcggtctcctggtgtacggccaacgccaagtaggggattgcgttccctccagtcgcagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggcatccttgttgggcaaatgtttcatttaaatgtgtcttatctagctagtatactctgaaaatttgagtatttaatattaggcatatgaagtggttgttgggaaaggagattccttcagaatatttagaatagcgtttaaggctctcaaggcttaggtatttaccatgagatggttgtggtcagttgcacctgataccatgtatccctgaatcatgtgtatttttattagtaatgcagccactaccattgctgatggggtctgtgtcctagtccctgtgggattggccttctgaagaaaagcacatttatggtacacaaggttgattctcagtttggtaggctctatagttccatcccagctgtctaattctgaagtgctccagtcttattggtgcccaatggggtaatctgtgcctcttccccaaaagcaatgacaggcaccagtgtctccacatttagatatattcccagtctctgtacatttaacagtactctctggggcaagcaataagtaggaccttgtgtgcagtttcattgtagagacatgtatatctgaggaataaaacagcttgttctgtgtcagtctgagatatgtggagattttgttcctatcctatagctcttttgtattctttggcatattttatatcctggtagaagaaaacaagtgcttgtttccaattttcttttttcttatttgctctcaggtagttcttactccatacaacaaagactttttgtttgttgggctttttttttttttttttttttgctctgtttcattttgttttagagacggggtttcaccatgttgtccaggctggtctcaaactcctgacctcaagtgatctgcccgccttggcctcccaaagttctgggattataggcgtgagctaccatgcctgacctgacttttgtttttagatattatgcttgccatgtgatagggcctgcaagcctcattgctaggcttactaagaaaattttagtttttcaaaagcattataatttcctaagaaactgaattctttttttatatgtttgagattcccatcattagtaatataagatgaaaggtaagtgccaaaaatgtatttttaaagaccctcaagtttaagatttatcctgattataagccaagttttatagtatatttaaccaattccatcaagaataattttaatatcaaaaattagtgttttctgtagccattgtccatgtcagagttacagtcctttttgtcattgataatataacctatgaagcagataaggattgaggaatatgactggaaggaattactatttagctaagctgacaaggtcgcttcttaagatgacatttggtttcagtaatctgactattctgttttcactttcatcttctttctaaatgaaaacaaaagtgctccctcccttcctggaaacctcagtaacactatgggaaaagtagaacatgacattgcagcctattgatttcttcttccagataggtttaaagtactccttaagttctgactaaatagaactaagccttattaaaaataactgcctcttgttcatgttatctgtaccttcagggacctgcctttcttcaagtatttcctagagtatctattatgatactgaagaagctaattatttgtgttgtaaatgggtataaatgaaaaaaaaacatactggtttctctagccaggaaaaatgctttctggtgtaatatatcttgctccagaaccctcattctaattgtaacactaggatcaaagaaacaaagtcactttgtggaccacagctaaactgtggatattttcccaaagacataagatttttatggcccgagcctctagaaaggaagccatgtttaggagcaaccagctttcctcccagctttagggggcagagttcctgagccagaggacttactgtccagctttgagaacctctccagagtatatgcactgggtactgctctttttcaagagaaccaaattaagaggatggcaagaaacagtagaagcacagaggaaagacaactctgcatgtgcctgtgtgaatgtgtgcatccatggagtatttcccaggtaaatactagtactggggacataggctaattgtgtgtcccacactgcaagatgctagggcgtagttaacactgtggtatacatacaaatcaggcactgtccaaaagattttttaaaatctaaagtctgaaatgtaaaaatataaggtctcaacccacttttacacttttaaagagatcccatacctgtttcactgactgccgttaattacacttttggatcacagctggttaaattgatagatttcagtttatctcagtgaatttttagaatggagattatagcattttttaattggagaacagacatttcctaaagtatatgaaaaaaaattattcactgttggtttaaaccagtatctttgtatgagtgccaaagatatatgaacacagatactgcctgtgcagacctaaattttagttttgtgtacctggatccatatacaaattttttgtggtttatagcataaaagcagaacgttgtttctttcttagttttcaaccggctcatcttttgtttttgttttttgtttttttgttttttgttttttttgagatggagtcttgctttgttgcccaggctagagtgcagtggcacaatctctgcttactgcaacctccacctccggggttcaagtgattctcctgcctcagcctcctgagtagctgggactacaggcgcgcaccaccatgcccggctaatttttgtatttttagtagagatggggtttcactatgttggccaggctggtctcgaactcctgacctcgtgatctgcccacctcagcctcccaaagtgctgggattacaggcgtgagccgccatgcccggccaattttcaactggcccatactttatagtgatggaaagcgcataaactacttgtaaatcattaaaatagggtgataactgtgataatagtgtttcttgcattctagaaaattattttattaactacattcaaaacccagcatttcacaggttccatcattagaaacagtatagttctagttaacatgattggagagtttcaggggaaaggtttacattttctgaaactgtatttggtatgtgactcaatgtggtatttcagtcttgttagtcacttacatgactgacgtttgcaaggatttattgccaagtaaaatttgaccagagtgcactgagaatagctacataaggggaaatctctcaaaattccttctgttcatttaatttggagcatattgtttaaatcattttaaacatatgtaaaaagttgaagcattaaaaaatcttcaagaaacaatgaaaaaatagaaattagcaaacataagtttcttaatgcaaaattaatagtgaataaaatatagcctacattaaaagccagaggctttgctataaatataagagtttagaaaaacagtgtgcttcaattaaggactaaattatcaaaactgcatgtttgttttttcttttcttttcttttttttttgagatgaagtctcactctgttgcccaggctggagtgcagtggtgcgatcttggctcactgcaacctctgcttcccaggttcaagcgattctcgtgcctcaccatcccgagtagctgggattacaggtgcaccacaccatgcccagttaatttttgtatttttagtagagacagggtttcattatttggccaggctggtctcgagctcctgatcttaagtgatccactcgcctcggcctcccaaagtgctgggattatacacatgagccactgtgcccagcctaaaactacatgttgaagcttccggtcatttccattattatccttcttttgaaattcaagttagtgctttttaaccaaataaaagaagaaccagctcttgggatatgtgactctgcctctgtataaagtgactggaattttgttaaaaccgtgtttccacttctgaaccctgttaccattccccctcacaaatccccacccaacacctggattttaaagatcctccagtgtcaagggaagccacagagtctattaaagaggcagttctgaaccaattaatttttgtccttataatttagagcattaaatagctaatatatttaatggcactaattgttgttcacggctttcatcatacttttaaacagaatccaaagtattcaaaggaaagtaagcgaagttatccaaagccaactttgtttcaggtgtgtcccctgccccaaatagattttagggcagaaatagaaaactgagtttacacagaactatttttggaaaagctgcactggagtagatggattcttcttcagcatacttttttgtttgtttgtttgagatggagtcttgctttgtcacccaggctggagtgcagtggtgtgatctccactcactgcaacctccacctcccagcttcaagtgattctcctgcctcaaccttccaagtagcttggattacaggcgtgcgccaccacagctggctaatatttgtattgttagtagagacagggtttcaccatgttgtccaggcttgtcgaacttctgacctcacgtgatccacctgcctcagcctcccaaagtgctagattataggcgtgaaccactgcgcccggccagcatgcattttaaaagtggcttagatttagttttaaatattttggggtgaaaggcaggaacagttctgtttttgacatacaggttttctttgggattgttttcattttcaagtatagattcatgtcagaatggccaacttaacgtgggtttctgtattccctggtgttgctcttaacctgaactcataatcagttgccatactgaggcaagagcactcagggtgaacatagtcaagttactttaaaagtgataaaagtgtttttccatggtgaaaccttcagtatttggctgaatgtaaagtatgttgaagtggtatattgatggtaagttgttaatcactaaccttgtttgcacttttgtacaccactgcttgcactaggatcttggtgtgaattttcaattgttttacagtgtatacagattattaaggataatttatataaagatgtttctgtttaactttgtgtgttttacaacaaagagctataatagatggttaaacgtttttgaattgtgtttatatgttagtttgattatgttctattatcttttcacctgccatgaatttgagtgttaggaagggaaaaataaaatactaatctggtcttgaagaactcta

SEQ ID NO: 179464 - DNA, 929 bp, Homo sapiens
  Payload ID: 15369
  Gene Symbol: SAR1B
  Gene Name: secretion associated, Ras related GTPase 1B
  Uniprot ID: Q9Y6B6
  ENST ID: ENST00000439578
  CDS Start-End: 185-781
gtgtacggccaacgccaagtaggggattgcgttccctccagtcgcagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaa

SEQ ID NO: 179465 - DNA, 548 bp, Homo sapiens
  Payload ID: 15369
  Gene Symbol: SAR1B
  Gene Name: secretion associated, Ras related GTPase 1B
  ENST ID: ENST00000502286
  CDS Start-End: 240-548
gatgcgaactggggccacggcagccatcgcgctttgcagttcggtctcctggtgtacggccaacgccaagtaggggattgcgttccctccagtcgcagacagagtttccctcttgtcgcccaggctggagtgaagtggcacgatctcggcttactgcaagctccgcctcccgggttcacgccattctcctgcctcagcctcccgagtagctgggactacagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgca

SEQ ID NO: 179466 - DNA, 506 bp, Homo sapiens
  Payload ID: 15369
  Gene Symbol: SAR1B
  Gene Name: secretion associated, Ras related GTPase 1B
  ENST ID: ENST00000509730
  CDS Start-End: 151-506
aaagaggcaaaggcagaggagaacaaaggaaggaggaagtaacttgtggaatgctgagaaaggtaaaaacaccttcaaataaggaagaggaacaggctatgacctaatgcttgcttggaccagtcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacgg

SEQ ID NO: 179467 - DNA, 455 bp, Homo sapiens
  Payload ID: 15369
  Gene Symbol: SAR1B
  Gene Name: secretion associated, Ras related GTPase 1B
  ENST ID: ENST00000509937
  CDS Start-End: 62-454
ggaaggaggaagtaacttgtggaatgctgagaaagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaac

SEQ ID NO: 179468 - DNA, 2287 bp, Homo sapiens
  Payload ID: 15369
  Gene Symbol: SAR1B
  Gene Name: secretion associated, Ras related GTPase 1B
  ENST ID: ENST00000507419
  CDS Start-End: 1374-1766
gaggtcactctctctatctatgtcgcctcaagcagcagtggcacgcaaaggtcagtcagccctggccaggctgcgccctccccccggacagcactcaccgttggtgtagggagaccccgaggccaaggcggctccgttctgggcctggaggctggctggggcgccgccggaggccggtattcccggctgggacatgatgactgggttggaaggggctggtcggggtcgacaacagcgcacaagaagagagctgaaagaccactgctgaaagcggagggaggaggctaacgacttaagactgaagactgggagaagaggggggggcgcattaagcccgaggcatggcgccgcactctccccaggccaccggcggccacagcctagcctgggagctgaggcttgagagtcgggccggcggggccgcgaacgcccggctagaaggcggcagccaaacctagagagaaggagggaggccctggccggaagtgcctgtcagccgccggccgcgcagccgcaatcaggacacgtggcacttccggctccgggctcgcagcagccgccgccgcgccggcgaactcttctctgccagccgggctgccccgaggccacctgacagctcctggtgccccgaccccgacgaccgtgcccggcctcgccgccacgtcaccgactctcacggccggccggaagtgccgtgtgtcaccgctacggaaattcccgccgttgtgaacgtgacctcgctcgcagagccaggatcgtggggcaatctgagattcagtagccgctttcgtggggtgggactgacagttcctctcctcgggttttgtgaagattacctgagaccatagaagtcatcgtcctctgttgagaccgtaccaccactgggagctggggcggttaatgttcatcgcagtatttcattcacatttcgtcttcgtgtttcagatgtaaattataaggggttttaaaaagaggtggttaaatatgtgtacatgttaatagtgtgatcaagccaagaaggaggcctttgtctttgactggaggactcagaggaattttaattttgaaactcgctgattcacagcatagtcacgctcaagttcattagcacatttaaatggcagttttgtttcctcttctaagagtttacagtaaggaaaaacaacattgctacacatgctaaaagatgacagacttggacaacatgtcccaacattacatcccaatggagtctcgctctgtcacccaggctggagtgcagtggcacgatctcgactcactgcaacctccgcctcccaagttcacaccattctcctgcctcagcttcccgagtagctggaactacagcttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaaagtacttggtttttacagtttataatctgacatcaccccagcgccatttgtaaagagcaactttccagcagtacatttgaagcactttttaacaacatgaaactataaaccatatttaaaagctcatcatgttaaattttttatgtacttttctggaactagtttttaaattttagattatatgtccacctatcttaagtgtacagttaataattagcttattcaatgattgcatgatgccttacagttttcaataactttttttcttatgcaaacgtcatgcaataaaacaaactctaatgtttggca

SEQ ID NO: 179469 - DNA, 733 bp, Homo sapiens
  Payload ID: 15369
  Gene Symbol: SAR1B
  Gene Name: secretion associated, Ras related GTPase 1B
  ENST ID: ENST00000503318
  CDS Start-End: 19-453
accctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgatgtcagatattttgtaaaggggcccaacagcagcaggcaaggtcagcaccagatctggggccacagagtaagcaggtccatgatttgattgaaggttgatcataccatggctctgcccagagcaggcaaacaaatacttgtacgtgtggaaaagtccagtcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggtta

SEQ ID NO: 179470 - DNA, 670 bp, Homo sapiens
  Payload ID: 15369
  Gene Symbol: SAR1B
  Gene Name: secretion associated, Ras related GTPase 1B
  ENST ID: ENST00000505758
  CDS Start-End: 161-670
cggccaacgccaagtaggggattgcgttccctccagtcgcaggcttttcaccattctttagctctcacctaccaacaatcatcttcagtgaggactttgccacttgattcacagtctgtatcagtgccctccagtcttccagaccctatcagatttggatatgtccttcatatttgattggatttacagtggtttcagcagtgtgctacagtttttaggattatataagaaaactggtaaactggtatttcttggattggataatgcaggaaaaacaacattgctacacatgctaaaagatgacagacttggacaacatgtcccaacattacatcccacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcc

SEQ ID NO: 179471 - DNA, 708 bp, Homo sapiens
  Payload ID: 15369
  Gene Symbol: SAR1B
  Gene Name: secretion associated, Ras related GTPase 1B
  ENST ID: ENST00000502539
  CDS Start-End: 104-496
tgctgagaaaggtaaaaacaccttcaaataaggaagaggaacaggctatgacctaatgcttgcttggaccagtgtaacttccgaagaactgaccattgctggcatgacgtttacaacttttgatctgggtggacatgttcaagctcgaagagtgtggaaaaactaccttcctgctatcaatggcattgtatttctggtggattgtgcagaccacgaaaggctgttagagtcaaaagaagaacttgattcactaatgacagatgaaaccattgctaatgtgcctatactgattcttgggaataagatcgacagacctgaagccatcagtgaagagaggttgcgagagatgtttggtttatatggtcagacaacaggaaaggggagtatatctctgaaagaactgaatgcccgacccttagaagttttcatgtgtagtgtgctcaaaagacaaggttacggagaaggcttccgctggatggcacagtacattgattaacacaaactcacattggttccaggtctcaacgttcaggcttactcagagatttgattgctcaacatgcataacttgaattcaatagacttttgctggttataaaacagatgttttttagattattaatattaaatcaacttaatttgaatgagaattgaaaactgattcaagtaagtttgagtatcacaatgttagctttctaattccataaa

SEQ ID NO: 179472 - DNA, 1566 bp, Homo sapiens
  Payload ID: 15370
  Gene Symbol: SERGEF
  Gene Name: secretion regulating guanine nucleotide exchange factor
  Uniprot ID: Q9UGK8
  ENST ID: ENST00000265965
  CDS Start-End: 153-1529
ctctctcccggcctgcgggccgcttcccaccacagaccccgccccgcgccctacccatcacgcgtccccggtccggctccggcgctcacctacccccggcaggcgccgcccccgtgccgtccctcccggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 179473 - DNA, 1124 bp, Homo sapiens
  Payload ID: 15370
  Gene Symbol: SERGEF
  Gene Name: secretion regulating guanine nucleotide exchange factor
  ENST ID: ENST00000532265
  CDS Start-End: 386-910
tgggtacgtgactccgcccccgggccggtgcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattgtatctctgcaaggtaagtattattatcccagttttgctgatgtggaaatggagttgcagagaaattaagagatatactcaagatcacagtgttcatgtgtcatggagccatttttgaatcctgtgagagacttcagtgctgatgatcggatgaccagaccatcaaaccatgctggaggtgattttttaattaccattctg

SEQ ID NO: 179474 - DNA, 1314 bp, Homo sapiens
  Payload ID: 15370
  Gene Symbol: SERGEF
  Gene Name: secretion regulating guanine nucleotide exchange factor
  ENST ID: ENST00000527494
  CDS Start-End: 331-507
gggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacaggacagcactaattggctgtggcagctgaggctcaggtgcttcgtgagtccacttgtggagtggaggaaggagagaggagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 179475 - DNA, 833 bp, Homo sapiens
  Payload ID: 15370
  Gene Symbol: SERGEF
  Gene Name: secretion regulating guanine nucleotide exchange factor
  ENST ID: ENST00000532546
  CDS Start-End: 1-381
ggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagatactgaactgcacagtgggagatgtggagatgaattcctagagctctggtctcaggaggccctccaggtggattctgcatcaagatagtcttttggagtaatagcaaggtctcttgtggctcagagcataatttggcaataattgtatctctgcaaggtaagtattattatcccagttttgctgatgtggaaatggagttgcagagaaattaagagatatactcaagatcacagtgttcatgtgtcatggagccatttttgaatcctgtgagagacttcagtgctgatgatcggatgaccagaccatcaaaccatgctggaggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatc

SEQ ID NO: 179476 - DNA, 541 bp, Homo sapiens
  Payload ID: 15370
  Gene Symbol: SERGEF
  Gene Name: secretion regulating guanine nucleotide exchange factor
  ENST ID: ENST00000533328
  CDS Start-End: 1-135
cctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctag

SEQ ID NO: 179477 - DNA, 793 bp, Homo sapiens
  Payload ID: 15370
  Gene Symbol: SERGEF
  Gene Name: secretion regulating guanine nucleotide exchange factor
  ENST ID: ENST00000530925
  CDS Start-End: 357-572
gcaggccctgaggggcgccgagatgtgggagctgctggccgcggcgtgggcagttcaggggctgggcggctgagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagaagtatagtttccagaagaaggaaggccaaagctcagccctttctgctgttcagcctgcatctgggatgttgtgttttgttgtggatttggtgcttaggccctgggcataaagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagac

SEQ ID NO: 179478 - DNA, 548 bp, Homo sapiens
  Payload ID: 15370
  Gene Symbol: SERGEF
  Gene Name: secretion regulating guanine nucleotide exchange factor
  ENST ID: ENST00000524716
  CDS Start-End: 3-125
gcatggagcgcgagcccagcgcctcggaggccgcccccgcggcggccgcgctcttcgcctgggtgtcttcaaaaacaaacatatttaaaagattttacttctcatctccaggaagaaccagctaggaggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctg

SEQ ID NO: 179479 - DNA, 1264 bp, Homo sapiens
  Payload ID: 15370
  Gene Symbol: SERGEF
  Gene Name: secretion regulating guanine nucleotide exchange factor
  Uniprot ID: Q9UGK8
  ENST ID: ENST00000528200
  CDS Start-End: 19-885
ccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaa

SEQ ID NO: 179480 - DNA, 1525 bp, Homo sapiens
  Payload ID: 15370
  Gene Symbol: SERGEF
  Gene Name: secretion regulating guanine nucleotide exchange factor
  ENST ID: ENST00000525422
  CDS Start-End: 27-1091
cggaagcgccggcggagcgtcctcgcatggagcgcgagcccagcgcctcggaggccgcccccgcggcggccgcgctcttcgcctggggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgagactagctttagatggcatctccttggaaagtcttccctgatgtccaggtcctaattgatcacttcattctctgaacttccagtaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaactggaaggaaagacaatcagaaacttcaacccaaagccaatctgactggtccagaaatgggggactgtgatagagaatctttaataaagtggcttttcccaccaaaa

SEQ ID NO: 179481 - DNA, 539 bp, Homo sapiens
  Payload ID: 15370
  Gene Symbol: SERGEF
  Gene Name: secretion regulating guanine nucleotide exchange factor
  ENST ID: ENST00000533241
  CDS Start-End: 1-433
agatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtctcttgtggctcagagcataatttggcaataattgtatctctgcaaggtaagtattattatcccagttttgctgatgtggaaatggagttgcagagaaattaagagatatactcaagatcacagtgttcatgtgtcatggagccatttttgaatcctgtgagagacttcagtgctgatgatcggatgaccagaccatcaaaccatgctg

SEQ ID NO: 179482 - DNA, 833 bp, Homo sapiens
  Payload ID: 15370
  Gene Symbol: SERGEF
  Gene Name: secretion regulating guanine nucleotide exchange factor
  ENST ID: ENST00000532389
  CDS Start-End: 422-833
gcaggccctgaggggcgccgagatgtgggagctgctggccgcggcgtgggcagttcaggggctgggcggctgaggtgtcttcaaaaacaaacatatttaaaagattttacttctcatctccaggaagaaccagctaggaggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttc

SEQ ID NO: 179483 - DNA, 893 bp, Homo sapiens
  Payload ID: 15370
  Gene Symbol: SERGEF
  Gene Name: secretion regulating guanine nucleotide exchange factor
  ENST ID: ENST00000530613
  CDS Start-End: 400-893
gggagctgctggccgcggcgtgggcagttcaggggctgggcggctgaggtgtcttcaaaaacaaacatatttaaaagattttacttctcatctccaggaagaaccagctaggagtagggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgc

SEQ ID NO: 179484 - DNA, 898 bp, Homo sapiens
  Payload ID: 15370
  Gene Symbol: SERGEF
  Gene Name: secretion regulating guanine nucleotide exchange factor
  ENST ID: ENST00000529151
  CDS Start-End: 1-898
tagaagtgcctcccagccctgagagttgttgtcatatgctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctcaccctgcattggtccaggaccccaaggtcacctacctttccccagatgccatcgaggacactgaatctcagaaagccatggacaaagagagaaa

SEQ ID NO: 179485 - DNA, 497 bp, Homo sapiens
  Payload ID: 15370
  Gene Symbol: SERGEF
  Gene Name: secretion regulating guanine nucleotide exchange factor
  ENST ID: ENST00000525920
  CDS Start-End: 1-318
ggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacaggtctcttgtggctcagagcataatttggcaataattggtggagtgtgttactcttggggctggaatgagcatggcatgtgcggagatggcactgaagccaacgtctgggccccaaagccggtgcaggctctgctgtcatcgtcaggactccttgtgggctgtggggctggccactccttggccctctgccagctgccagctc

SEQ ID NO: 179486 - DNA, 1396 bp, Homo sapiens
  Payload ID: 15370
  Gene Symbol: SERGEF
  Gene Name: secretion regulating guanine nucleotide exchange factor
  ENST ID: ENST00000529728
  CDS Start-End: 711-1396
ccggtgcaggccctgaggggcgccgagatgtgggagctgctggccgcggcgtgggcagttcaggggctgggcggctgaggtccgagccgggctctgggttgaaggatcctgggctgggagcggagggggagcggaggaggagcgggcgggcggggaaggaagggtcttcgcggtcgacttaggggcctgccggctggcggggtcagggccggaggggctgtggcgccgcgggaagaacctgcctcggggcagagcgtctggttccgcgagagccctccagcccgaatagcgcctggaagacagcgcggagggctcggtggagaggatcgcccggtcccagagctccgtggggccacctgtgccccccacactcctgatgcctggaggagggagaccctgtcccagcctggcgaaagcatcctttagatggtgcaaatagctatgggcaacttggcctcggccataaggaagatgtgctgttgccccagcaactgaatgacttctgtaaacccaggagtgtcaggaggatcacaggaggagggggccactctgcagttgtcacagatggaggagacctctttgtttgtggcctgaacaaagatgggcaactggggcttggtcacacagaggatatcccatattttaccccctgcaaatccctctttggctgtcccatccaacaggtggcctgtggctgggattttacgattatgctcacagaaaatggtcaagttctatcatgtggatccaactcctttggccagttaggagttcctcatggacctcgaagatgtgtggttccccaggccattgagctccataaagagaaggttgtttgtattgctgctggactgaggcatgcagtagctgctacagcgagtggcatcgtgttccagtgggggactggtttggcatcatgtggacgacggttgtgccctgggcagactcttccattgtttttcacagcaaaggaaccaagcagagtgacaggtctagagaattctaaagcaatgtgtgttcttgctggctcagaccactcagcttcattaacagatgcaggagaggtgtatgtttggggaagcaacaagcatgggcaactggctaatgaggctgctttccttcctgtgccccagaaaatagaagcacattgtttccagaatgaaaaggtcactgccatctggagtggatggacacacctggttgctcagacagaaactggcaagatgtttacctggggccgagcagactatggtcagctagggaggaagttggagacttatgaaggctggaaactagaaaagcaagattcatttctcccctgttcaagaccaccgaacagcatgccttcgtctccgcattgcttaactggagcaactgaggtaggaagtgacttctc

SEQ ID NO: 179487 - DNA, 441 bp, Homo sapiens
  Payload ID: 15371
  Gene Symbol: SCGB1A1
  Gene Name: secretoglobin, family 1A, member 1 (uteroglobin)
  Uniprot ID: P11684
  ENST ID: ENST00000278282
  CDS Start-End: 62-337
actagcccaccagactcagagacggaaccagagacgggccagagcatccccctcctccaccatgaaactcgctgtcaccctcaccctggtcacactggctctctgctgcagctccgcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 179488 - DNA, 466 bp, Homo sapiens
  Payload ID: 15371
  Gene Symbol: SCGB1A1
  Gene Name: secretoglobin, family 1A, member 1 (uteroglobin)
  ENST ID: ENST00000534397
  CDS Start-End: 192-362
ggcagggcaggcagaggggaaacgagtgaaggccggaggtgctctgagggtgtcccttaccctggagtctgccttggagatcatttcaccatcagctcagaagatcttctttctctgttttcagccacacagcgtttcattcttctgcagagatctgcccgagctttcagcgtgtcatcgaaaccctcctcatggacacaccctccagttatgaggctgccatggaacttttcagccctgatcaagacatgagggaggcaggggctcagctgaagaagctggtggacaccctcccccaaaagcccagagaaagcatcattaagctcatggaaaaaatagcccaaagctcactgtgtaattagcatttagaagctgaagatccccaactgctccagcctctgccgctgccatgctttgagtccacgcccaccagccttgctctcttcaataaaccacaagcatctca

SEQ ID NO: 179489 - DNA, 431 bp, Homo sapiens
  Payload ID: 15372
  Gene Symbol: SCGB1C1
  Gene Name: secretoglobin, family 1C, member 1
  Uniprot ID: Q8TD33
  ENST ID: ENST00000342878
  CDS Start-End: 21-308
cagctcctgagactgctggcatgaaggggagccgtgccctcctgctggtggccctcaccctgttctgcatctgccggatggccacaggggaggacaacgatgagtttttcatggacttcctgcaaacactactggtggggaccccagaggagctctatgaggggaccttgggcaagtacaatgtcaacgaagatgccaaggcagcaatgactgaactcaagtcctgtatagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccg

SEQ ID NO: 179490 - DNA, 478 bp, Homo sapiens
  Payload ID: 15373
  Gene Symbol: SCGB1C2
  Gene Name: secretoglobin, family 1C, member 2
  Uniprot ID: P0DMR2
  ENST ID: ENST00000595228
  CDS Start-End: 66-353
ggtgctgtccggtgaggcataaaatcccgggattctggctggaggcagctcctgagactgccggcatgaaggggagccgtgccctcctgctggtggccctcaccctgttctgcatctgccggatggccacgggggaggacaacgatgagtttttcatggacttcctgcaaacactactggtggggaccccagaggagctctatgaggggaccttgggcaagtacaatgtcaacgaagatgccaaggcagcaatgactgaactcaagtcctgcagagatggcctgcagccaatgcacaaggcggagctggtcaagctgctggtgcaagtgctgggcagtcaggacggtgcctaagtggacctcagacatggctcagccataggacctgccacacaagcagccgtggacacaacgcccactaccacctcccacatggaaatgtatcctcaaaccgtttaatcaataaagcctcttccgca

SEQ ID NO: 179491 - DNA, 478 bp, Homo sapiens; identical to SEQ ID NO: 179490
  Payload ID: 15373
  Gene Symbol: SCGB1C2
  Gene Name: secretoglobin, family 1C, member 2
  Uniprot ID: P0DMR2
  ENST ID: ENST00000613221
  CDS Start-End: 66-353

SEQ ID NO: 179492 - DNA, 453 bp, Homo sapiens
  Payload ID: 15374
  Gene Symbol: SCGB1D1
  Gene Name: secretoglobin, family 1D, member 1
  Uniprot ID: O95968
  ENST ID: ENST00000306238
  CDS Start-End: 70-342
aggctcccggggctgagtctaaatcactcatcattggttaaagccgagctcacagcagaataagccaccatgaggctgtcggtgtgtctcctgctgctcacgctggccctttgctgctaccgggcaaatgcagtggtctgccaagctcttggttctgaaatcacaggcttcttattagctggaaaacctgtgttcaagttccaacttgccaaatttaaggcacctctggaagctgttgcagccaagatggaagtgaagaaatgcgtggatacgatggcctatgagaaaagagtgctaattacaaaaacattgggaaaaatagcagagaaatgtgatcgctgagatgtaaaaagtttttaatgctagtttccaccatctttcaatgataccctgatcttcactgcagaatgtaaaggtttcaacgtcttgctctaataaatcacttgccctgaa

SEQ ID NO: 179493 - DNA, 480 bp, Homo sapiens
  Payload ID: 15375
  Gene Symbol: SCGB1D2
  Gene Name: secretoglobin, family 1D, member 2
  Uniprot ID: O95969
  ENST ID: ENST00000244926
  CDS Start-End: 99-371
acaaatagccctgggctctgcagctccacaggctcctggggtggagtccaaatcactcattgtttgtgaaagctgagctcacagcaaaacaagccaccatgaagctgtcggtgtgtctcctgctggtcacgctggccctctgctgctaccaggccaatgccgagttctgcccagctcttgtttctgagctgttagacttcttcttcattagtgaacctctgttcaagttaagtcttgccaaatttgatgcccctccggaagctgttgcagccaagttaggagtgaagagatgcacggatcagatgtcccttcagaaacgaagcctcattgcggaagtcctggtgaaaatattgaagaaatgtagtgtgtgacatgtaaaaactttcatcctggtttccactgtctttcaatgacaccctgatcttcactgcagaatgtaaaggtttcaacgtcttgctttaataaatcacttgctctcca

SEQ ID NO: 179494 - DNA, 439 bp, Homo sapiens
  Payload ID: 15376
  Gene Symbol: SCGB1D4
  Gene Name: secretoglobin, family 1D, member 4
  Uniprot ID: Q6XE38
  ENST ID: ENST00000358585
  CDS Start-End: 55-306
gtcgaatccaaatcactcattgtgaaagctgagctcacagccgaataagccaccatgaggctgtcagtgtgtctcctgatggtctcgctggccctttgctgctaccaggcccatgctcttgtctgcccagctgttgcttctgagatcacagtcttcttattcttaagtgacgctgcggtaaacctccaagttgccaaacttaatccacctccagaagctcttgcagccaagttggaagtgaagcactgcaccgatcagatatcttttaagaaacgactctcattgaaaaagtcctggtggaaatagtgaaaaaatgtggtgtgtgacatgtaaaaatgctcaacctggtttccaaagtctttcaacgacaccctgatcttcactaaaaattgtaaaggtttcaacacgttgctttaataaatcacttgccctgcacatc

SEQ ID NO: 179495 - DNA, 521 bp, Homo sapiens
  Payload ID: 15377
  Gene Symbol: SCGB2A1
  Gene Name: secretoglobin, family 2A, member 1
  Uniprot ID: O75556
  ENST ID: ENST00000244930
  CDS Start-End: 65-352
cctccacagcaacttccttgatccctgccacgcacgactgaacacagacagcagccgcctcgccatgaagctgctgatggtcctcatgctggcggccctcctcctgcactgctatgcagattctggctgcaaactcctggaggacatggttgaaaagaccatcaattccgacatatctatacctgaatacaaagagcttcttcaagagttcatagacagtgatgccgctgcagaggctatggggaaattcaagcagtgtttcctcaaccagtcacatagaactctgaaaaactttggactgatgatgcatacagtgtacgacagcatttggtgtaatatgaagagtaattaactttacccaaggcgtttggctcagagggctacagactatggccagaactcatctgttgattgctagaaaccacttttctttcttgtgttgtctttttatgtggaaactgctagacaactgttgaaacctcaaattcatttccatttcaataaactaactgcaaatcact

SEQ ID NO: 179496 - DNA, 505 bp, Homo sapiens
  Payload ID: 15378
  Gene Symbol: SCGB2A2
  Gene Name: secretoglobin, family 2A, member 2
  Uniprot ID: Q13296
  ENST ID: ENST00000227918
  CDS Start-End: 63-344
tccacagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatgcaattaatatatgacagcagtctttgtgatttattttaactttctgcaagacctttggctcacagaactgcagggtatggtgagaaaccaactacggattgctgcaaaccacaccttctctttcttatgtctttttactacaaactacaagacaattgttgaaacctgctatacatgtttattttaataaattgatggca

SEQ ID NO: 179497 - DNA, 1305 bp, Homo sapiens
  Payload ID: 15378
  Gene Symbol: SCGB2A2
  Gene Name: secretoglobin, family 2A, member 2
  ENST ID: ENST00000525380
  CDS Start-End: 60-422
acagcggcttccttgatccttgccacccgcgactgaacaccgacagcagcagcctcaccatgaagttgctgatggtcctcatgctggcggccctctcccagcactgctacgcaggctctggctgccccttattggagaatgtgatttccaagacaatcaatccacaagtgtctaagactgaatacaaagaacttcttcaagagttcatagacgacaatgccactacaaatgccatagatgaattgaaggaatgttttcttaaccaaacggatgaaactctgagcaatgttgaggtgtttatggtaatttcattttcttcctataagctttttaaatcccctgaccagggacaagtgggctcttcatttctcactgacaatgccaaagccactagtgaacaagccttttcttacattggttaatttagttgaatggttagtctaatgactttgccatcaagaaaaacatccagtgtccctgtgttgtcactctacccagagaatcctcagtggatgataaatgaatagggcaagagaggaaaaggaaaggtcggtagaagtcttacctatccccagagctctctaattcatgctcacaaacacagacacaatcacacaaacacagaaacacacatacacacatccagacacatgcaaacacacagacacagtcacaatcacacaaacacacacacattcagacatacacaaacatagacagacaggcaaagacacagacacagacacagacacaatcacaccagcacacaatcatccagacacaaacacaaacacacagacagaaccacacaaccacagaaacacagagacacacacaaacacactcagacacacacatacaaacatatgttcactctctacagaaaaaacaattttccagaagacccgcacctatagaccaatctgcagagaaaacttctcttcttcaaaaaaaagtaaaagtgttctttcttaaaaaatgccctatttttcaacagtttggaaaataccatttgagcaagattctatacatctcaaataaaaagaatttaaaatgcacttccaggcaatcataatttgctagcataaatgatgagaaaccttggactatccaataggcaactgtagatcatgggtatgaaaccaccatggaggaagaattgcctcaaacaaaaaccaatagttttgtatttctttctaactatacatgtatattgttgagggttttctttagcatttattccctatgttaaattcttctttaatccttccctggtaaaaaaaaaaaaaaaaaaaaagttagaaa

SEQ ID NO: 179498 - DNA, 426 bp, Homo sapiens
  Payload ID: 15379
  Gene Symbol: SCGB2B2
  Gene Name: secretoglobin, family 2B, member 2
  Uniprot ID: Q4G0G5
  ENST ID: ENST00000379204
  CDS Start-End: 23-313
gctgggaccagactccgctgtcatgagggtgacatccgccacctgtgctcttctgctggctctgatctgcagcgtccagctgggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctc

SEQ ID NO: 179499 - DNA, 2505 bp, Homo sapiens
  Payload ID: 15379
  Gene Symbol: SCGB2B2
  Gene Name: secretoglobin, family 2B, member 2
  Uniprot ID: Q4G0G5
  ENST ID: ENST00000601241
  CDS Start-End: 2102-2392
agccagaccaggaacccaccagaaggaaccaattccggacacataacaagcagcagtgaggacaccaaagacacagacccagatgcagaggcagaggcagccacacagcccctcccagccacaatcacaacctcatattcatataatcacagaccctccaccccacatagtgggtggaatcctgccagcgcattccactcacacacacacaaaatcccattctcacacacgtgcacccaagcctcgtcccgcacacacaacatgacaggccacagagccggctgagagtctcagcacgcatggacgcctgcactgcgcaggttgcagcccaggctgcaggaccacaggtggcagggacgacacagcaggtggccggccagggagtggcagtggcctccatcctccctgctcagccacagcccctgcttcagcgtctgccagtccaactgtcaactcatccactcaactttacaactggaatgtgggggcgttcagggccctgccactggtgacggccactctaagtcctacccaatgctgggtaggtcctttaagaggcccaagtcctgggcgctactatgaggttctgtacgtgcacagtgatggctcatgcctggccgaggtgagcccactcagtctgggtggcacagcctaatctaggaactgctctgcggttctacatggctctcagcagcccagtgagtgtcctctgcaccgggcgtgtccctcaggtgctcctagccagaccctcccttgacacagtagggcacaaaccgctattggagcggcactggcacccgagtgtacaagcgtcagcatccctgctgccttccccacccccagctgtccccacctgctgattctgcccctggggtcacacttacaatttagggtcctgtcaggagacaaaaatcacgtgagtgacatcagctccctcatatgtaggtgctgggaaaagggcttgtggggtgcctgtataaactggccataaaaatacgggaataagttgtggaaagccacaaaaggcctctgaggaggaaagcctcctaattgccatcatgttcccatgctcagagcaagacccgctgtcttctctgtaaacactgtgctcagggagaaagacacttctttgaaacactggaatgtggacagacgtgcaggctcccagtcaaggccgctcctactagctactctccaacaagttaaagttatgctgtttgagcacaaaggagactcatttaaactgctattgctatagattatgcctgtgatgcactgccaccctttcactgtttctccctgaacatctgcttcttagatcgaagggactgtactcaataaatagtgtggagaccagagctcggcaccttttgcagcctccacattttgcactggccccctggctccccacctttcactcttaacttgtcttttctcaatcctttgtcaccaccagacttcgggtaccctacgggtagtgttgaggctggtccccaacatgtaggatcccttcactgtgtcacatgtgtccctaacacacttgctacatctcatgtcctttaggttctgtgttttactccagataatgttctttgaatctaaattacagtttactgatttctcaaaagctgcacctaatgtgctatccattcagacagacatactcacttagcaaatgtttgttgagccagcactcagtggcagattctgtgctagggcgtgccaagtgcagacacacgtttgccaagacacagggtcacatgtgcatgcacactcagacttgcaggcttacaccagtgttcagcctgctcccaatcccagggagctccagggaggacagagagaatgtcacaacacccaacccctcccactgcatgctgagtccagttcccgatacgctgccaccccaacagcatggcccagggccgagggtctctctgcagacctgccctgaccacattcacacacacacacacacacacacacacacacacacacacacacacacacacgaagaggcatgtgccttgttcagatatacataaagctcacccatcgccaaattccctgcctgtgcctgctgggaccagactccgctgtcatgagggtgacatccgccacctgtgctcttctgctggctctgatctgcagcgtccagctgggggatgcctgcctggatatcgataaactgcttgcgaatgttgtgtttgatgtgtcccaagacctcctgaaggaggagcttgctcgttacaaccccagtcccctgacagaggagtccttcctcaatgtccagcaatgctttgccaatgtctccgtgacagaaagatttgctcattcagttgttattaagaagatccttcagagcaacgattgcatagaagcagccttctgatctgaggacccctgcagatcagatattggccctcctgccttccttggggctccccgcgttcctggcctggctctgttcatcactacagagaccccaatgaacacctgcagctc

SEQ ID NO: 179500 - DNA, 521 bp, Homo sapiens
  Payload ID: 15380
  Gene Symbol: SCGB3A1
  Gene Name: secretoglobin, family 3A, member 1
  Uniprot ID: Q96QR1
  ENST ID: ENST00000292641
  CDS Start-End: 79-393
gcgaggaccgggtataagaagcctcgtggccttgcccgggcagccgcaggttccccgcgcgccccgagcccccgcgccatgaagctcgccgccctcctggggctctgcgtggccctgtcctgcagctccgctgctgctttcttagtgggctcggccaagcctgtggcccagcctgtcgctgcgctggagtcggcggcggaggccggggccgggaccctggccaaccccctcggcaccctcaacccgctgaagctcctgctgagcagcctgggcatccccgtgaaccacctcatagagggctcccagaagtgtgtggctgagctgggtccccaggccgtgggggccgtgaaggccctgaaggccctgctgggggccctgacagtgtttggctgagccgagactggagcatctacacctgaggacaagacgctgcccacccgcgagggctgaaaaccccgccgcggggaggaccgtccatccccttcccccggcccctctcaataaacgtggttaagagcagc

SEQ ID NO: 179501 - DNA, 515 bp, Homo sapiens
  Payload ID: 15381
  Gene Symbol: SCGB3A2
  Gene Name: secretoglobin, family 3A, member 2
  Uniprot ID: Q96PL1
  ENST ID: ENST00000296694
  CDS Start-End: 94-375
acactttgtatggcaagtggaaccactggcttggtggattttgctagatttttctgatttttaaactcctgaaaaatatcccagataactgtcatgaagctggtaactatcttcctgctggtgaccatcagcctttgtagttactctgctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatac

SEQ ID NO: 179502 - DNA, 440 bp, Homo sapiens
  Payload ID: 15381
  Gene Symbol: SCGB3A2
  Gene Name: secretoglobin, family 3A, member 2
  ENST ID: ENST00000504320
  CDS Start-End: 154-300
cataacctgcctttgctggtgtgtggcgattaggcctggtggaaccaccatcaataaatcaagcgtgatcaggctactgccttcctcatcaacaaagtgccccttcctgttgacaagttggcacctttacctctggacaacattcttccctttatggatccattaaagcttcttctgaaaactctgggcatttctgttgagcaccttgtggaggggctaaggaagtgtgtaaatgagctgggaccagaggcttctgaagctgtgaagaaactgctggaggcgctatcacacttggtgtgacatcaagataaagagcggaggtggatggggatggaagatgatgctcctatcctccctgcctgaaacctgttctaccaattatagatcaaatgccctaaaatgtagtgacccgtgaaaaggacaaataaagcaatgaatac

SEQ ID NO: 179503 - DNA, 2576 bp, Homo sapiens
  Payload ID: 15382
  Gene Symbol: SCG2
  Gene Name: secretogranin II
  Uniprot ID: P13521
  ENST ID: ENST00000305409
  CDS Start-End: 234-2087
aaatataaagtgattattttctcttggttctttgaaaaacctcgcttgtgctggggtttgtggctgaacccggtgacgtcagtgtggcagtgcggagtcaggcgcagcggctccctataagcagaggagctgtccgtgtgctgaaacggcccgagaagctcgcccggagaacggggaggaatatgctgtggagctcctctgccatataaacaaaaagaggaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttccaatggacatgagtgatgattatgagacacagcagtggccagaaagaaagcttaagcacatgcaattccctcctatgtatgaagagaattccagggataacccctttaaacgcacaaatgaaatagtggaggaacaatatactcctcaaagccttgctacattggaatctgtcttccaagagctggggaaactgacaggaccaaacaaccagaaacgtgagaggatggatgaggagcaaaaactttatacggatgatgaagatgatatctacaaggctaataacattgcctatgaagatgtggtcgggggagaagactggaacccagtagaggagaaaatagagagtcaaacccaggaagaggtgagagacagcaaagagaatatagaaaaaaatgaacaaatcaacgatgagatgaaacgctcagggcagcttggcatccaggaagaagatcttcggaaagagagtaaagaccaactctcagatgatgtctccaaagtaattgcctatttgaaaaggttagtaaatgctgcaggaagtgggaggttacagaatgggcaaaatggggaaagggccaccaggctttttgagaaacctcttgattctcagtctatttatcagctgattgaaatctcaaggaatttacagatacccccagaagacttaattgagatgctcaaaactggggagaagccgaatggatcagtggaaccggagcgggagcttgaccttcctgttgacctagatgacatctcagaggctgacttagaccatccagacctgttccaaaataggatgctctccaagagtggctaccctaaaacacctggtcgtgctgggactgaggccctaccagacgggctcagtgttgaggatattttaaatcttttagggatggagagtgcagcaaatcagaaaacgtcgtattttcccaatccatataaccaggagaaagttctgccaaggctcccttatggtgctggaagatctagatcgaaccagcttcccaaagctgcctggattccacatgttgaaaacagacagatggcatatgaaaacctgaacgacaaggatcaagaattaggtgagtacttggccaggatgctagttaaataccctgagatcattaattcaaaccaagtgaagcgagttcctggtcaaggctcatctgaagatgacctgcaggaagaggaacaaattgagcaggccatcaaagagcatttgaatcaaggcagctctcaggagactgacaagctggccccggtgagcaaaaggttccctgtggggcccccgaagaatgatgataccccaaataggcagtactgggatgaagatctgttaatgaaagtgctggaatacctcaaccaagaaaaggcagaaaagggaagggagcatattgctaagagagcaatggaaaatatgtaagctgctttcattaattaccctactttcattcctcccaccccaagcaaatcccaacatttctcttcagtgtgttgacttctatcctgttaacactgtaatatctttaaatgatgtacaggcagatgaaaccaggtcactggggagtctgcttcatttcctctgagctgttatcttgtgtatggatatgtgtaaatgttatgactccttgataaaaaatttattatgtccattattcaagaaagatatctatgactgtgtttaatagtatatctaatggctgtggcattgttgatgctcacatatgataaaaaagtgtcctataattctattgaaagtttttaatatttattgaattattttgttactgtctgtagtgttttgtggagtactggaccaaaaaaataaagcattataaatatatagttttatttataaggccttttctattgtgtgttttactgttgattaataaatgttatttctggacaa

SEQ ID NO: 179504 - DNA, 589 bp, Homo sapiens
  Payload ID: 15382
  Gene Symbol: SCG2
  Gene Name: secretogranin II
  ENST ID: ENST00000421386
  CDS Start-End: 158-589
gtaaggctgcttttctctttgatttattggaaagttccaaattgcatgctcttcttttaattcctagctgagaagaaaaagactgtttggcaagcttatgtcgataggataactgaatagcaacctgctgctcatcagccaatgaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctcagtctgcaccaaaagaaaataagccctatgccttgaattcagaaaagaactttcca

SEQ ID NO: 179505 - DNA, 544 bp, Homo sapiens
  Payload ID: 15382
  Gene Symbol: SCG2
  Gene Name: secretogranin II
  ENST ID: ENST00000433889
  CDS Start-End: 168-544
gaaacggcccgagaagctcgcccggagaacggggaggaatatgctgtggagctcctctgccatataaacaaaaagagctgagaagaaaaagactgtttggcaagcttatgtcgataggataactgaatagcaacctgctgctcatcagccaatgaaatctttcaaacatggctgaagcaaagacccactggcttggagcagccctgtctcttatccctttaattttcctcatctctggggctgaagcagcttcatttcagagaaaccagctgcttcagaaagaaccagacctcaggttggaaaatgtccaaaagtttcccagtcctgaaatgatcagggctttggagtacatagaaaacctccgacaacaagctcataaggaagaaagcagcccagattataatccctaccaaggtgtctctgtcccccttcagcaaaaagaaaatggcgatgaaagccacttgcccgagagggattcactgagtgaagaagactggatgagaataatactcgaagctttgagacaggctgaaaatgagcctca

SEQ ID NO: 179506 - DNA, 3315 bp, Homo sapiens
  Payload ID: 15383
  Gene Symbol: SCG3
  Gene Name: secretogranin III
  Uniprot ID: Q8WXD2
  ENST ID: ENST00000220478
  CDS Start-End: 404-1810
gttccattcccgggggattggagtagcgttggagtcaccgacgccatcccctcccgcctctggcgtgcatggagcatgcgcttccttcctcacttcctctgcaggagggagcgagagtaaagctacgccctggcgcgcagtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagacaaatctctacataatagagaattaagtgcagaaagacctttgaatgaacagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgacataaaaaggatccaggtaaatgggtataggatttgctggatttactaacaatttccccctgttcttaacacttcctattagtgacttttcagacattgagtttacttataaagagagatatttatgtactctctaagaagacaaatgaggtcataaacactgcataaagcaaggcaaaaatgtatgccacatctcagttatctaaactagattagatccaagccaagttttctcaacagagagcaaagggccaggcagtaaggtagaaatagagataaaaatcattccttccttgtgatccaaagctggtcgagcagctttcctggaggaaaaggttaatgaacttcaggtccctgcaactcagcccccaccacaaacacagccctggaaacatacagtggcgcaaggtcctcttgaaatgttaatggttaatgttcccaaaccagagaatgctttgaaaatgtatcattcagtgtaaattaattacatacatatttttctatatatttgtttcaaactgtaaaaataacataatatgtaatttgtgtattagtgagaggtgaagccagctggacttcctgggtcgagtggggccttggagaacttttctgtcttacaagaggattgtaaaatgcacccatcagtgctctgtaaaacacaccaatcagcgctctgtagctagcaataggtttgtaaaatgcacccatcagcactctgtaaaacgcaccaatcagcactctgtaaaatgcaccaatcagcaggattctaaaagtagacaatcacagggaggattgaaaaaaagggcactctgatagggcaaaaacggaacatgggaggggacaaataagggaataaaatctggccaccccagccagcagcagcaacctgttcaggtcgcctgccgctgtggaagctttgtccttttgctcttcataataaaccttgctactgttcactctt

SEQ ID NO: 179507 - DNA, 2163 bp, Homo sapiens
  Payload ID: 15383
  Gene Symbol: SCG3
  Gene Name: secretogranin III
  Uniprot ID: Q8WXD2
  ENST ID: ENST00000542355
  CDS Start-End: 908-1618
gtctccgcgtcacaggaacttcagcacccacagggcggacagcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatgatccagatggtcttcatcaactagacgggactcctttaaccgctgaagacattgtccataaaatcgctgccaggatttatgaagaaaatgacagagccgtgtttgacaagattgtttctaaactacttaatctcggccttatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcagaaaaagaagcaaaagagaaagaaacactgattactatcatgaaaacactgattgactttgtgaagatgatggtgaaatatggaacaatatctccagaagaaggtgtttcctaccttgaaaacttggatgaaatgattgctcttcagaccaaaaacaagctagaaaaaaatgctactgacaatataagcaagcttttcccagcaccatcagagaagagtcatgaagaaacagacagtaccaaggaagaagcagctaagatggaaaaggaatatggaagcttgaaggattccacaaaagatgataactccaacccaggaggaaagacagatgaacccaaaggaaaaacagaagcctatttggaagccatcagaaaaaatattgaatggttgaagaaacatgacaaaaagggaaataaagaagattatgacctttcaaagatgagagacttcatcaataaacaagctgatgcttatgtggagaaaggcatccttgacaaggaagaagccgaggccatcaagcgcatttatagcagcctgtaaaaatggcaaaagatccaggagtctttcaactgtttcagaaaacataatatagcttaaaacacttctaattctgtgattaaaattttttgacccaagggttattagaaagtgctgaatttacagtagttaaccttttacaagtggttaaaacatagctttcttcccgtaaaaactatctgaaagtaaagttgtatgtaagctgagattttgtatacagaatccttatttcctcatagacttatattttataatcagaatatgttgctttgaaaaagcctctaatggactgaccttaaaactcatccttcttccactgtctcatccacataagcactccccgaagaattaagggggttctgttttcaaggcatgccaagtactaaagcaccttgcagagcgtgtctattacaagatgtcatttccaccagcagttcccttaggggagctgaaataaattcacattttctcaaagtctcatagctttggaggagccatctgcttttttggctgctctttttagctggctttttattaggctcagtgac

SEQ ID NO: 179508 - DNA, 896 bp, Homo sapiens
  Payload ID: 15383
  Gene Symbol: SCG3
  Gene Name: secretogranin III
  ENST ID: ENST00000558709
  CDS Start-End: 725-896
agcgctcccctctacctggagacttgactcccgcgcgccccaaccctgcttatcccttgaccgtcgagtgtcagagatcctgcagccgcccagtcccggcccctctcccgccccacacccaccctcctggctcttcctgtttttactcctccttttcattcataacaaaagctacagctccaggagcccagcgccgggctgtgacccaagccgagcgtggaagaatggggttcctcgggaccggcacttggattctggtgttagtgctcccgattcaagctttccccaaacctggaggaagccaagattgctgaagcagaagaagacaagattaaaaaaacatatcctccagaaaacaagccaggtcagagcaactattcttttgttgataacttgaacctgctaaaggcaataacagaaaaggaaaaaattgagaaagaaagacaatctataagaagctccccacttgataataagttgaatgtggaagatgttgattcaaccaagaatcgaaaactgatcgatgattatgactctactaagagtggattggatcataaatttcaagatcacagaaagccaagcacatacactggaagatgaagtagcagaggttttacaaaaattaatctcaaaggaagccaacaattatgaggaggatcccaataagcccacaagctggactgagaatcaggctggaaaaataccagagaaagtgactccaatggcagcaattcaagatggtcttgctaagggagaaaacgatgaaacagtatctaacacattaaccttgacaaatggcttggaaaggagaactaaaacctacagtgaagacaactttgaggaactccaatatttcccaaatttctatgcgctactgaaaagtattgattcag

SEQ ID NO: 179509 - DNA, 1238 bp, Homo sapiens
  Payload ID: 15384
  Gene Symbol: SCG5
  Gene Name: secretogranin V
  Uniprot ID: P05408
  ENST ID: ENST00000300175
  CDS Start-End: 111-749
taagatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggca

SEQ ID NO: 179510 - DNA, 1235 bp, Homo sapiens
  Payload ID: 15384
  Gene Symbol: SCG5
  Gene Name: secretogranin V
  Uniprot ID: P05408
  ENST ID: ENST00000413748
  CDS Start-End: 111-746
taagatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggca

SEQ ID NO: 179511 - DNA, 1148 bp, Homo sapiens
  Payload ID: 15384
  Gene Symbol: SCG5
  Gene Name: secretogranin V
  ENST ID: ENST00000494364
  CDS Start-End: 88-669
actagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgca

SEQ ID NO: 179512 - DNA, 659 bp, Homo sapiens
  Payload ID: 15384
  Gene Symbol: SCG5
  Gene Name: secretogranin V
  ENST ID: ENST00000471027
  CDS Start-End: 1-651
tctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggagggtaacacgtgcctggctggattgttgcggggatgcttggagctttctgagtggggcagtgaacaggctgaaaccctcgcttgttgggaagtcacagaatcctcccttgtgtagtcctgagaaacactggtccatgtgacaagggcc

SEQ ID NO: 179513 - DNA, 949 bp, Homo sapiens
  Payload ID: 15384
  Gene Symbol: SCG5
  Gene Name: secretogranin V
  ENST ID: ENST00000497208
  CDS Start-End: 85-669
agctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatg

SEQ ID NO: 179514 - DNA, 1244 bp, Homo sapiens
  Payload ID: 15384
  Gene Symbol: SCG5
  Gene Name: secretogranin V
  ENST ID: ENST00000614359
  CDS Start-End: 118-756
gcggagctaagatgcggaggagggtgacgcactagctctccagttcgcccgttcctggcctgacccccaccaaggcccataccgcagtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggc

SEQ ID NO: 179515 - DNA, 659 bp, Homo sapiens; identical to SEQ ID NO: 179512
  Payload ID: 15384
  Gene Symbol: SCG5
  Gene Name: Secretogranin V
  ENST ID: ENST00000633221
  CDS Start-End: 1-651

SEQ ID NO: 179516 - DNA, 1238 bp, Homo sapiens
  Payload ID: 15384
  Gene Symbol: SCG5
  Gene Name: Secretogranin V
  ENST ID: ENST00000632219
  CDS Start-End: 111-749
taagatgcggaggagggtgacgcactagctctccagttcgcccgttcctggcctgacccccaccaaggcccataccgctgtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggca

SEQ ID NO: 179517 - DNA, 1235 bp, Homo sapiens
  Payload ID: 15384
  Gene Symbol: SCG5
  Gene Name: Secretogranin V
  ENST ID: ENST00000632674
  CDS Start-End: 111-746
taagatgcggaggagggtgacgcactagctctccagttcgcccgttcctggcctgacccccaccaaggcccataccgctgtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggaacaagaaactcctttacgagaagatgaagggaggagagagacgaaagcggaggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgcaagcattggca

SEQ ID NO: 179518 - DNA, 949 bp, Homo sapiens
  Payload ID: 15384
  Gene Symbol: SCG5
  Gene Name: Secretogranin V
  ENST ID: ENST00000633420
  CDS Start-End: 85-669
agctctccagttcgcccgttcctggcctgacccccaccaaggcccataccgctgtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagcagatgatggatgtctagaaaacacccctgacactgcagagttcagtcgagagttccagttgcaccagcatctctttgatccggaacatgactatccaggcttgggcaagtggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatg

SEQ ID NO: 179519 - DNA, 1148 bp, Homo sapiens
  Payload ID: 15384
  Gene Symbol: SCG5
  Gene Name: Secretogranin V
  ENST ID: ENST00000632955
  CDS Start-End: 88-669
actagctctccagttcgcccgttcctggcctgacccccaccaaggcccataccgctgtaggctcctcgggctgcccctcggttgacaatggtctccaggatggtctctaccatgctatctggcctactgttttggctggcatctggatggactccagcatttgcttacagcccccggacccctgaccgggtctcagaagcagatatccagaggctgcttcatggtgttatggagcaattgggcattgccaggccccgagtggaatatccagctcaccaggccatgaatcttgtgggcccccagagcattgaaggtggagctcatgaaggacttcagcatttgggtccttttggcaacatccccaacatcgtggcagagttgactggagacaacattcctaaggactttagtgaggatcaggggtacccagaccctccaaatccctgtcctgttggaaaaacagatgatggatgtctagaaaacacccctgacactgcagagttcagtcgagagttccagttgcaccagcatctctttgatccggaacatgactatccaggcttgggcaagtggagtgtcaatccatatctacaaggacagagactggataatgttgttgcaaagaagtctgtcccccatttttcagatgaggataaggatccagagtaaagagaagatgctagacgaaaacccacattacctgttaggcctcagcatggcttatgtgcacgtgtaaatggagtccctgtgaatgacagcatgtttcttacatagataattatggatacaaagcagctgtatgtagatagtgtattgtcttcacaccgatgattctgctttttgctaaattagaataagagcttttttgtttcttgggtttttaaaatgtgaatctgcaatgatcataaaaattaaaatgtgaatgtcaacaataaaaagcaagactatgaaaggctcagatttcttgcagtttaaaatggtgtctgaggttgtactattttggccaagtctgtagaaagctgtcatttgattttgattatgtagttcatccagcccttgggcattgttatacaccagtaaagaaggctgtactcaagaggaggagctgacacatttcacttggctgcgtcttaataaacatgaatgca

SEQ ID NO: 179520 - DNA, 1276 bp, Homo sapiens
  Payload ID: 15385
  Gene Symbol: SCAMP1
  Gene Name: secretory carrier membrane protein 1
  Uniprot ID: O15126
  ENST ID: ENST00000614488
  CDS Start-End: 62-535
ggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgtgagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttag

SEQ ID NO: 179521 - DNA, 477 bp, Homo sapiens
  Payload ID: 15385
  Gene Symbol: SCAMP1
  Gene Name: secretory carrier membrane protein 1
  ENST ID: ENST00000510030
  CDS Start-End: 352-477
actgcgtctgcccctcggctccccttagcagcccagagaggggcgcggggccgccgtcctccatttggggtcgcgccccggccccgtgtcactcctttgggttttggggcttgggggtggaacctcctcagctcgtgcccggtcgcccttccacacgtccccgactggtgagggtcgtgtctgcagccgggactgggcccgcgcgcccggaggggtcctggcccgcctctcaggagagaaagccgagggcaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaacta

SEQ ID NO: 179522 - DNA, 3766 bp, Homo sapiens
  Payload ID: 15385
  Gene Symbol: SCAMP1
  Gene Name: secretory carrier membrane protein 1
  ENST ID: ENST00000320280
  CDS Start-End: 1-619
agaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcagtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgtt

SEQ ID NO: 179523 - DNA, 1358 bp, Homo sapiens
  Payload ID: 15385
  Gene Symbol: SCAMP1
  Gene Name: secretory carrier membrane protein 1
  ENST ID: ENST00000618166
  CDS Start-End: 62-1000
ggcctcgcctcgtctctctctctgcgcctgggtcgggtgggtgacgccgagagccagagagatgtcggatttcgacagtaacccgtttgccgacccggatctcaacaatcccttcaagcctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttag

SEQ ID NO: 179524 - DNA, 4509 bp, Homo sapiens
  Payload ID: 15385
  Gene Symbol: SCAMP1
  Gene Name: secretory carrier membrane protein 1
  Uniprot ID: O15126
  ENST ID: ENST00000621999
  CDS Start-End: 90-1106
cggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaacctcagtcaacatggtagaaaaaataattggccacctcttcctagcaattttcctgtcggaccttgtttctatcaggatttttctgtagacattcctgtagaattccaaaagacagtaaagcttatgtactacttgtggatgttccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggagtgacagttcatttagattctttgtattcttcttcgtctatatttgtcagtttgctgtacatgtactccaagctgcaggatttcataactggggcaattgtggttggatttcatcccttactggtctcaaccaaaatattcctgttggaatcatgatgataatcatagcagcacttttcacagcatcagcagtcatctcactagttatgttcaaaaaagtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttat

SEQ ID NO: 179525 - DNA, 559 bp, Homo sapiens
  Payload ID: 15385
  Gene Symbol: SCAMP1
  Gene Name: secretory carrier membrane protein 1
  ENST ID: ENST00000511551
  CDS Start-End: 201-559
ctctctgcgcctgggtcgggtgggtgacgccgagagccagagagatgtcggatttcgacagtaacccgtttgccgacccggatctcaacaatcccttcaagataatgtgtctataaacattcctgtacaagtgttctgtttgatcacctgttttaaattcttttggggatatatacctacaagtggaattgcctagtcatatggtaactctgtttaatcatggaggagcttccagacccttttccaaagtggctgtaccattttatattcctgctagcagtgtatgggatccatcagttacacaagtgacaagaaatgttccaccaggacttgatgaatataatccattctcggattctagaacacctccaccaggcggtgtgaagatgcctaatgtacccaatacacaaccagcaataatgaaaccaacagaggaacatccagcttatacacagattgcaaaggaacatgcattggcccaagctgaacttcttaagcgccaggaagaactagaaagaaaagccgcagaattagatcgtcgggaacgagaaatgcaaaa

SEQ ID NO: 179526 - DNA, 2453 bp, Homo sapiens
  Payload ID: 15386
  Gene Symbol: SCAMP2
  Gene Name: secretory carrier membrane protein 2
  Uniprot ID: O15127
  ENST ID: ENST00000268099
  CDS Start-End: 111-1100
agaaccgctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagacaa

SEQ ID NO: 179527 - DNA, 790 bp, Homo sapiens
  Payload ID: 15386
  Gene Symbol: SCAMP2
  Gene Name: secretory carrier membrane protein 2
  ENST ID: ENST00000565345
  CDS Start-End: 511-790
ggggcgcgactagcagcaggtggaactgcagaggaggcggggcgctgaagtgttggagacagtggggtcttctagcacccggaggctgggctgtgctagggaaggggactggagcaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctggggg

SEQ ID NO: 179528 - DNA, 858 bp, Homo sapiens
  Payload ID: 15386
  Gene Symbol: SCAMP2
  Gene Name: secretory carrier membrane protein 2
  ENST ID: ENST00000569904
  CDS Start-End: 48-758
cggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgcactccctc

SEQ ID NO: 179529 - DNA, 2476 bp, Homo sapiens
  Payload ID: 15386
  Gene Symbol: SCAMP2
  Gene Name: secretory carrier membrane protein 2
  ENST ID: ENST00000566480
  CDS Start-End: 1-837
tcagagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagcttctttgtgttcttctttgtatttttttgtcaaatagggatctacatcatccagttggttggcatccctggcctgggggacagcggttggattgcagccctgtctacactggataatcattccctggccatatcagtcatcatgatggtggtggctggcttcttcaccctctgtgccgtgctctcagtcttcctcctgcagcgggtgagtggtgtgggcagggctgacagcaaatgggaggaggcaggcaaccgtttcctgcccttgccacgagatgtttttcaccactgcagttgggcatcctaggcccccaaaggtccagtacctttctccagggatctgggtggggggtcaggcagtgccaggcttctggtgacccctttgggagtataacctggatggctggcttcctggtgggcccaaaggacaggcttctctcaccccacccctcttcgccaggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaatttttgtgcttaagtaaaaataaaaacattttcagac

SEQ ID NO: 179530 - DNA, 1787 bp, Homo sapiens
  Payload ID: 15386
  Gene Symbol: SCAMP2
  Gene Name: secretory carrier membrane protein 2
  ENST ID: ENST00000563663
  CDS Start-End: 101-274
cctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagccctgtctacactggataatcattccctggccatatcagtcatcatgatggtggtggctggcttcttcaccctctgtgccgtgctctcagtcttcctcctgcagcgggtgcactccctctaccgacggacaggggccagcttccagcaggcccaggaggagttttcccagggcatcttcagcagcagaaccttccacagagctgcttcatctgctgcccaaggagccttccaggggaattagtcctcctctcttctctccccctcagcctttctctcgcctgccttctgagctgcactttccgtgggtgccttatgtggtggtggttgtgcccagcacagacctggcagggttcttgccgtggctcttcctcctccctcagcgaccagctctccctggaacgggagggacagggaattttttccccctctatgtacaaaaaaaaacaaagctctctttccttctctggtgatggtttggtaggattcttttgtctctggaagcagtgggactgaagttctcttcgtcctgtgcacacacagacacccccacacagttgggatcacaggctgacctgggcccatcccagctggagctttctgccagggtcctgggccttgactcccccaccctgcaggcctggcctgaatctggcttcttagacacagcccagtccttcctgcctgggctgggaataagcctctcacaggttctggtggacagatctgttccccaggtcactccagtggtctccaggcttccagagaaggctggttgcctcaagctcttctctgcctcataaacggatccagagaaggctggttgccttaagctcttccctgcctcgtgttcctgagaaacggattaatagccctttatccccctgcaccctcctgcaggggatggcactttgagccctctggagccctccccttgctgagccttactctcttcagactttctgaatgtacaatgccgttggttgggatttggggactggaagggaccaaggacactgaccccaagctgtcctgcctagcgtccagcgtcttctaggagggtggggtctgcctgtcctggtgtggttggtttggccctgtttgctgtgactacccccccccctccccgaaccgagggacggctgcctttgtctctgcctcagatgccacctgccccgcccatgctccccatcagcagcatccagactttcaggaagggcagggccagccagtccagaaccgcatccctcagcagggactgataagccatctctcggagggccccctaatacccagtggagtctggttcacaccctggggggtgtgtcactgtgatgggacacgtaggagtccacccttaaaaccagcaccctgtccctcgaggctgccgagtgggtgtgtggactggggtgccttcccacaaaactagcctccggctctgggcccgagacagccgcaggccccagccactgaatgatactggcagcggctggggttttatgaactcctttctggtattttttcccctctatgtacaaatgtatatgttacgtctcaattttt

SEQ ID NO: 179531 - DNA, 866 bp, Homo sapiens
  Payload ID: 15386
  Gene Symbol: SCAMP2
  Gene Name: secretory carrier membrane protein 2
  ENST ID: ENST00000564529
  CDS Start-End: 104-866
ctgcctcgctcccggaagtggagggtctacacgaagcgccgctgggtctgggtgcccggaggcagcagcgttcgcggagttcgcccgctggcccccgatcaccatgtcggctttcgacaccaaccccttcgcggacccagtggatgtaaaccccttccaggatccctctgtgacccagctgaccaacgccccgcagggcggcctggcggaattcaaccccttctcagagacaaatgcagcgacaacagttcctgtcacccaactccctgggtcctcacagccagcggttctccagccatcagtggaaccaacccagccgaccccccagctcctgcttagacaggccagcaagttcccgcctgcccaattcctggcagtgagcgagctctcagagaggcagatgctcctaggaggagaaagtattctcagagacagctacatgcgaaagcttccgaaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggt

SEQ ID NO: 179532 - DNA, 638 bp, Homo sapiens
  Payload ID: 15386
  Gene Symbol: SCAMP2
  Gene Name: secretory carrier membrane protein 2
  ENST ID: ENST00000562363
  CDS Start-End: 56-638
tgggtgcccggaggcagcagcgttcgcggagttcgcccgctggcccccgatcaccatgtcggctttcgacaccaaccccttcgcggacccagtggatgtaaaccccttccagacaaatgcagcgacaacagttcctgtcacccaactccctgggtcctcacagccagcggttctccagccatcagtggaaccaacccagccgaccccccaggccgtggtgtctgcagcccaggcaggcctgctccggcagcaggaagaactggacaggaaagctgccgagctggaacgcaaggagcgggagctgcagaacactgtagccaacttgcatgtgagacagaacaactggccccctctgccctcgtggtgccctgtgaagccctgcttctatcaggatttctccacagagatccctgccgactaccagcggatatgcaagatgctctactatctgtggatgttgcattcagtgactctgtttctgaacctgcttgcctgcctggcctggttctcgggcaacagctccaagggagtggactttggcctctccatcctgtggtttctgatcttcactccctgtgccttcctttgttggtaccgacccatctataaggcctttaggtccgacaactctttcagct

SEQ ID NO: 179533 - DNA, 1446 bp, Homo sapiens
  Payload ID: 15387
  Gene Symbol: SCAMP3
  Gene Name: secretory carrier membrane protein 3
  Uniprot ID: O14828
  ENST ID: ENST00000302631
  CDS Start-End: 109-1152
agcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcaggacccagctgtgatccagcaccgacccagccggcagtatgccacgcttgacgtctacaacccttttgagacccgggagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgaca

SEQ ID NO: 179534 - DNA, 1537 bp, Homo sapiens
  Payload ID: 15387
  Gene Symbol: SCAMP3
  Gene Name: secretory carrier membrane protein 3
  Uniprot ID: O14828
  ENST ID: ENST00000355379
  CDS Start-End: 280-1245
ggaaggaagtcacatggaagaggggcggtagttggttgtgggcactgggttagaggtatcacgtgggggcactttcgtcttagcttttggacaagacgcaggcgcaacccacggctgctgcggggatccttgtggcccttccggtcggtggaaccaatccgtgcacagagaagcggggcgaactgaggcgagtgaagtggactctgagggctaccgctaccgccactgctgcggcaggggcgtggagggcagagggccgcggaggccgcagttgcaaacatggctcagagcagagacggcggaaacccgttcgccgagcccagcgagcttgacaacccctttcagccaccaccagcctatgagcctccagcccctgccccattgcctccaccctcagctccctccttgcagccctcgagaaagctcagccccacagaacctaagaactatggctcatacagcactcaggcctcagctgcagcagccacagctgagctgctgaagaaacaggaggagctcaaccggaaggcagaggagttggaccgaagggagcgagagctgcagcatgctgccctggggggcacagctactcgacagaacaattggccccctctaccttctttttgtccagttcagccctgctttttccaggacatctccatggagatcccccaagaatttcagaagactgtatccaccatgtactacctctggatgtgcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggagtgacagttcattcaatttcttcgttttcttcttcattttcttcgtccaggatgtgctctttgtcctccaggccattggtatcccaggttggggattcagtggctggatctctgctctggtggtgccgaagggcaacacagcagtatccgtgctcatgctgctggtcgccctgctcttcactggcattgctgtgctaggaattgtcatgctgaaacggatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactga

SEQ ID NO: 179535 - DNA, 1537 bp, Homo sapiens; identical to SEQ ID NO: 179534
  Payload ID: 15387
  Gene Symbol: SCAMP3
  Gene Name: secretory carrier membrane protein 3
  Uniprot ID: O14828
  ENST ID: ENST00000573013
  CDS Start-End: 280-1245

SEQ ID NO: 179536 - DNA, 1446 bp, Homo sapiens; identical to SEQ ID NO: 179533
  Payload ID: 15387
  Gene Symbol: SCAMP3
  Gene Name: secretory carrier membrane protein 3
  Uniprot ID: O14828
  ENST ID: ENST00000570831
  CDS Start-End: 109-1152

SEQ ID NO: 179537 - DNA, 2684 bp, Homo sapiens
  Payload ID: 15388
  Gene Symbol: SCAMP4
  Gene Name: secretory carrier membrane protein 4
  Uniprot ID: Q969E2
  ENST ID: ENST00000316097
  CDS Start-End: 268-957
catgtgagcgcagtgccggagcggggcggggcgaggcggcggcgcgcagtgcctactagcaattgtagtccttgccccaccttggcctggcgaagatcccgcccctggaactacgctcccgtcgtgctccgcggctccaggcggagacgaggcggggtgaggtgggttgggccgggccggttgctaagacttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacaagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccccccacccctcccccgccgtgtgtggcccctcgccgcatcgttggggttttgttatgtgaaaatatcctggaaataaatacatgtttctgcactta

SEQ ID NO: 179538 - DNA, 2394 bp, Homo sapiens
  Payload ID: 15388
  Gene Symbol: SCAMP4
  Gene Name: secretory carrier membrane protein 4
  Uniprot ID: Q969E2
  ENST ID: ENST00000409472
  CDS Start-End: 78-665
ttggcgaagcgctgcgctcgcgcccggatccctcaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgctccccaaacccagcaaaccggcagagagccggtttcccagcagccggagccctgcaggagaggcctttgtgttttgttttgttttgttttttctcttttgagacaagagtttcactctgtcgcccaggctggagtgcagtggtgtgatctcggctcactgcaacctctgcctcccgtgttcaagcagttctcctgcctcagcctcccaaatagctgggattacagttgcctgccaccacgcccagctaatttttatatttttagtacagatggggtttcaccatgttggccaggctggtctcgaactcctgacctcaagtgatccacccgccttggcctcccaaagtgctgggataataggtgtcagccaccgcgcccagcctggagtggccttttatgagaggggacccgtcaaatctgtgccttatggaggggtccggcagcggccacaattgtcttgtcccctcaccccccaactccccctggaacacctctcccaggcaagacattttcacagcaccattcacaacggttgggccaaaaagaaacttttccttcatcatttcctgcactcgctgaccacaactttggacaccccaggctgccacccctccccacccgttcacccccaggatgctgttgctgtaggacgcctgctgccctggagccctccccaggatgtgagccagtcccctcgctggtacggaatgccgctgggtgcccggaggcggccatggtgtctcgatggacggcagccaggatggagcacccatgggtctcacggccatgcttcagggtcttcaggtcctgcccccggccagtctgccaagaggcacccccttccccagcctctcgcctgcactgatgcagacaaaatctcacctggcaggcccaacccccccccacccctcccccgccgtgtgtggcccctcgccgcatcgttggggttttgttatgtgaaaatatcctggaaataaatacatgtttctgcacttaga

SEQ ID NO: 179539 - DNA, 783 bp, Homo sapiens
  Payload ID: 15388
  Gene Symbol: SCAMP4
  Gene Name: secretory carrier membrane protein 4
  ENST ID: ENST00000411971
  CDS Start-End: 414-783
actgcatctccggttctgtgctttgttgaacgcgtgagcttcgggcagcgctggggccgcttcagcgtgacctccaaggccactggcctggagttccactggctgctggtcccccatctgtggggcgccccggcggctgaggcgtggaccaggcagtgcatgtcgaggagtagcacccacagctgcgcggctgcgaaatgatccagagacacatccctgtctgcgggaggagccgtccataccagcggggatgtgtagtccaggctggcagttcaggatcacccggctggagtcattttaagatcatctgcggcttagccccagcaccatctgaggcagtactgtctgctagaaataactgtgagcacacaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcga

SEQ ID NO: 179540 - DNA, 570 bp, Homo sapiens
  Payload ID: 15388
  Gene Symbol: SCAMP4
  Gene Name: secretory carrier membrane protein 4
  ENST ID: ENST00000590266
  CDS Start-End: 400-570
gcttccaggtgttccgcggggtgctggaggagcagtgccgctggctggaccccgacacgtaggcgccgccctcctgcctccggacccttcccgctcccggccgtggggcgcccctcctggacttccgggcctcgatttcttccgcacaagcctgaccgtggatttcagggacacataccgcctccagcggggagcacgggtgctgccttccgtgcggatcgagctttcctggactcggtcattggggccaccccgtgccagcggtgcccttctgcggccgcccttgctgcgtttgtgtcccctctgtctcgcgggccgggaaactgctctgatgggaaaataaacagcccaaaaccaagcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcc

SEQ ID NO: 179541 - DNA, 547 bp, Homo sapiens
  Payload ID: 15388
  Gene Symbol: SCAMP4
  Gene Name: secretory carrier membrane protein 4
  ENST ID: ENST00000588907
  CDS Start-End: 481-547
gtgctttgttgaacgcgtgagcttcgggcagcgctggggccgcttcagcgtgacctccaaggccactggcctggagttccactggctgctggtcccccatctgtggggcgccccggcggctgaggcgtggaccaggcagtgcatgtcgaggagtagcacccacagctgcgcggctgcgaaatgatccagagacacatccctgtctgcgggaggagccgtccataccagcggggatgtgtagtccaggctggcagttcaggatcacccggctggagtcattttaagatcatctgcggcttagccccagcaccatctgaggcagtactgtctgctagaaataactgtgagcacacagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggct

SEQ ID NO: 179542 - DNA, 1172 bp, Homo sapiens
  Payload ID: 15388
  Gene Symbol: SCAMP4
  Gene Name: secretory carrier membrane protein 4
  Uniprot ID: Q969E2
  ENST ID: ENST00000621748
  CDS Start-End: 66-755
agtcgtgggtggatgtcaggccaggcggctgcaggcttcagcctgcgctggttggtgaaacagagatgtcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgt

SEQ ID NO: 179543 - DNA, 1477 bp, Homo sapiens
  Payload ID: 15388
  Gene Symbol: SCAMP4
  Gene Name: secretory carrier membrane protein 4
  ENST ID: ENST00000414057
  CDS Start-End: 188-609
ggttgggccgggccggttgctaagacttggcgaagcgctgcgctcgcgcccggatccctcagaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccaggcgattggcttctccggctggggcgcgtgcggctggctgtcggcaattggattcttccagtacagcccgggcgctgccgtggtcatgctgcttccagccatcatgttctccgtgtcggctgccatgatggccatcgcgatcatgaaggtgcacaggatctaccgaggggctggcggaagcttccagaaggcacagacggagtggaacacgggcacttggcggaacccaccgtcgagggaggcccagtacaacaacttctcaggcaacagcctgcccgagtaccccactgtgcccagctacccgggcagtggccagtggccttagagggagcctgccctgcccccaccgcccaccacctcctccccttcattcctgctgctacccctggtcccgagggctgggagtacctggggccccatccccccagctgggatggtggaagccggtggtggccacggaccgcccccctcctgccagggccacagaacccgtgttcatctcatccgagagcggagttcctcacaagcactccccagcagcccttggcctctgccgtccacaggacgccctcttgctcccggaaacgtgtggtcacccgccgtccactgcacggctggtacggccttgtcttcaggtctcgaggcctgactccgggggacaggtggcagcaggtcggccgccctcccgtcctcccagagctgctggcgctgaggtcagagcgggtctgatggggagctccgtctcaccggccacccgccgtcaccatggcagatgcccttggccggaactaataagaggcgtcggggccagcttccggtcccctgcagtgatagagggcttggtgcctagctgagtcctcgctgtccccgccatcccctgatctgtgcggctccagcctcgccccctccccacgtgcaccatacctggggagttcctggtccagggtatcctggggccaccctccctgcctccaaaacagggatccctggcaggctgtctttccacgcccctgagttcagagtcggggacccaggccaggtcgggagcacagccgct

SEQ ID NO: 179544 - DNA, 569 bp, Homo sapiens
  Payload ID: 15388
  Gene Symbol: SCAMP4
  Gene Name: secretory carrier membrane protein 4
  ENST ID: ENST00000460767
  CDS Start-End: 91-198
cggttgctaagacttggcgaagcgctgcgctcgcgcccggatccctcaggcggctgcaggcttcagcctgcgctggttggtgaaacagagatgtcaggcgcccagggacacttcctcaggcagtgctggctgagcagaagctcctggggggctcccagtgccacgctgagtgccccaaaggctgtgttcccatcttgatccctggaacctaaaaggagaacaacttcccgccactgcccaagttcatccctgtgaagccctgcttctaccagaacttctccgacgagatcccagtggagcaccaggtcctggtgaagaggatctaccggctgtggatgttttactgcgccaccctcggcgtcaacctcattgcctgcctggcctggtggatcggcggaggctcggggaccaacttcggcctggccttcgtgtggctgctcctgttcacgccttgcggctacgtgtgctggttccggcctgtctacaaggccttccgagccgacagctcctttaatttcatggcgtttttcttcatcttcggagcccagtttgtcctgaccgtcatccag

SEQ ID NO: 179545 - DNA, 3427 bp, Homo sapiens
  Payload ID: 15389
  Gene Symbol: SCAMP5
  Gene Name: secretory carrier membrane protein 5
  Uniprot ID: Q8TAC9
  ENST ID: ENST00000361900
  CDS Start-End: 208-915
tccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtg

SEQ ID NO: 179546 - DNA, 3411 bp, Homo sapiens
  Payload ID: 15389
  Gene Symbol: SCAMP5
  Gene Name: secretory carrier membrane protein 5
  Uniprot ID: Q8TAC9
  ENST ID: ENST00000425597
  CDS Start-End: 191-898
ggcctcgggcgcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctgtgt

SEQ ID NO: 179547 - DNA, 710 bp, Homo sapiens
  Payload ID: 15389
  Gene Symbol: SCAMP5
  Gene Name: secretory carrier membrane protein 5
  ENST ID: ENST00000568081
  CDS Start-End: 126-632
ggaaatccctccctgtgtaatgttgcaacacacaggtctaccacgtggaaacttgcaaagatgtatgggtagaactaaccccttctgacctctcaattaaggcctttaaatgtcttctgtccattatgcacttaaacttggaagggcttgggggccttgaaggcagggaagccctggccctctgcccaggtgacgggagccacctcctctgccgcaggactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttacc

SEQ ID NO: 179548 - DNA, 561 bp, Homo sapiens
  Payload ID: 15389
  Gene Symbol: SCAMP5
  Gene Name: secretory carrier membrane protein 5
  ENST ID: ENST00000566872
  CDS Start-End: 276-561
tccgcgccgcatcgctcgggtgcagcgcagctcagcgcagcgctgcggcctttcggcagccgaacggccgcggcagcatttcctttacaggctgcacttccttccctgctgccagccaggagtttcggaaggtttcctggaggaagtgtgatacagcaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaagg

SEQ ID NO: 179549 - DNA, 588 bp, Homo sapiens
  Payload ID: 15389
  Gene Symbol: SCAMP5
  Gene Name: secretory carrier membrane protein 5
  ENST ID: ENST00000567920
  CDS Start-End: 218-588
agccccggagcggctcgcggccggctccgcgccgcatcgctcgggtgcagcgcagctcagcgcagcgctgcggcctttcggcagccgaacggccgcggcaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgt

SEQ ID NO: 179550 - DNA, 516 bp, Homo sapiens
  Payload ID: 15389
  Gene Symbol: SCAMP5
  Gene Name: secretory carrier membrane protein 5
  ENST ID: ENST00000564779
  CDS Start-End: 72-516
attgcattcacggcactgtgggattcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcgg

SEQ ID NO: 179551 - DNA, 966 bp, Homo sapiens
  Payload ID: 15389
  Gene Symbol: SCAMP5
  Gene Name: secretory carrier membrane protein 5
  ENST ID: ENST00000567529
  CDS Start-End: 34-171
tgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgccccacactggcctcttcctgcagcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctct

SEQ ID NO: 179552 - DNA, 3400 bp, Homo sapiens
  Payload ID: 15389
  Gene Symbol: SCAMP5
  Gene Name: secretory carrier membrane protein 5
  Uniprot ID: Q8TAC9
  ENST ID: ENST00000562212
  CDS Start-End: 159-890
cccgcccccagccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttggtcatcagcatcatccaggccgtgggcatcccaggctggggcgtctgccccacactggcctcttcctgcagcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtgggtgggagggtgggtacaggccagggatattcccttgctcttttgatccctccaggcctcgcctccttcagcctcctcctccctcatctgttccctgatgtcacattccctgtgcaatcttcccttgcccatggtctgtctatctctttcctatgtggcttttctttgtcttccccaaggctgagtgtcccagttttatctgctcctgagactgagcccagatccccaaatctaatctgatttacagttcaaggaagctgatggggagctgggccttacccctgatgtaggaggggcacacagctgggggtgcagagcccacctgggtacctgacccccaggggatgaaaatgcaaggatgagtctgcttgggcctgagagtttgatctgcaggggcaggctcatcttttctctcccctgccttctcctccttctctccccagagcccccttgagcccctctgcctatgtccctctgcctcctccccatgcccccagttgctgtggcttgattctgctaccctgaccccaccatgtgccaggtggcatctgccttactgccttccctgaggagctgggacatgctgggcagttgtcagatgtaaaggcacagctggagcagagggcatgtcagtaatgattggtccctggggaaggtctggctggctccagcacagtgaggcatttaggtatctctcggtgaccgttggattcctggaagcagtagctgttctgtttggatctggtaggacagggctcagagggctaggcacggagggaaggtcagaggagaaggcaggcagggcccagtgagaggggagcatgccttcccccaccctggcttgctcttggtcacagggcggttctgggcacttgaactcagggcccaagcagaagcacaggcccagtcctggctgcaagcacaatagcctgaatgggatttcaggttaggcagggtgggaggggaggctctctggctttagttttgttttgttttccaaatcaaggtaacttgctcccttctgcctacaggccttggtcttggcttgtcctcacccagtcggaactccctaccactttcaggagagtggttttaggcccgtggggctgttctgttccaagcagtgtgagaacatggctggtagaggctctagctgtgtgcggggcctgaaggggagtgggttctcgcccaaagagcatctgcccatttcccaccttcccttctcccaccagaagcttgcctgagctgtttggacaaaaatccaaaccccacttggctactctggcctggcttcagcttggaacccaatacctaggcttacaggccatcctgagccaggggcctctggaaattctcttcctgatggtcctttaggtttgggcacaaaatataattgcctctcccctctcccattttctctcttgggagcaatggtcacagtccctggtacctgaaaaggtacctaggtctaggcccttcttccctttcccttcctctcccctaccccagaactttggctccctttcccttctctctctggtagctccaggaggcctgtgatccagctccctgcctagcatccatgacctgttggatgttacctccaatcagtttcctgtcctacctgcctctttggcttggacctatatggccatgctctggctctacccttgggaagcctgatcccggtgtgtggcccagcttgttcaggccctgggatgctgcatctccaggcaactatgcactttcccggggagagaaccagtatgagaagtgggggcagggcacacattcatctttgtaggaaggtctggcctggggtcgggtgaaggagggcccaggtcagttctggggtcccagtgacctgctttgccattctcctggtgccgctgctgctccctgtttctggagctggatgttccccagctggcagttgagctgcctgagccaatgtgtctgtctttggtaactgagtgaaccataataaaggggaacatttggccctg

SEQ ID NO: 179553 - DNA, 1206 bp, Homo sapiens
  Payload ID: 15389
  Gene Symbol: SCAMP5
  Gene Name: secretory carrier membrane protein 5
  ENST ID: ENST00000562765
  CDS Start-End: 150-287
agccccggagcggctcgcggccggctccgcgccgcatcgctcgggtgcagcgcagctcagcgcagcgctgcggcctttcggcagccgaacggccgcggcagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtgctagatgtgtgtttagagctaaaccagcccccacccccaccctccacctgcccctcttgcctctggcccctctgaccctggcccagggacccctcacggggccaggggaggcatagcagaaagactggccccttcctagggttatgagctggaactgtttctactttcagtcttcctgggaagtaacagtacttagcactcttggtggtggg

SEQ ID NO: 179554 - DNA, 579 bp, Homo sapiens
  Payload ID: 15389
  Gene Symbol: SCAMP5
  Gene Name: secretory carrier membrane protein 5
  ENST ID: ENST00000562327
  CDS Start-End: 231-579
gcgcgcgcgcgcgcgcgcgctccccgcccccagccccggagcggctcgcggccggctccgcgccgcatcgctcgggtgcagcgcagctcagcgcagcgctgcggcctttcggcagccgaacggccgcggcagaaccccgaccaagaacagatgccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaagactgacagctccttcagtttcatggcattcttctttaccttcatggctcagttgg

SEQ ID NO: 179555 - DNA, 600 bp, Homo sapiens
  Payload ID: 15389
  Gene Symbol: SCAMP5
  Gene Name: secretory carrier membrane protein 5
  ENST ID: ENST00000568018
  CDS Start-End: 308-600
gcgcgctccccgcccccagccccggagcggctcgcggccggctccgcgccgcatcgctcgggtgcagcgcagctcagcgcagcgctgcggcctttcggcagccgaacggccgcggcagacggagtcttgctctgtcgccgggctggagggcagtggcacgatctcggctcactgcaacctctgcctcccaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccaccaactttggcctcgcctttctctggctcatcctcttcacaccctgctcctacgtctgctggtttcggcccatttacaaggccttcaa

SEQ ID NO: 179556 - DNA, 554 bp, Homo sapiens
  Payload ID: 15389
  Gene Symbol: SCAMP5
  Gene Name: secretory carrier membrane protein 5
  ENST ID: ENST00000565989
  CDS Start-End: 347-554
aaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgttgaacagcgtcacgctggccgtgaacctggtgggctgtctcgcgtggctgatcggaggcgggggagccacca

SEQ ID NO: 179557 - DNA, 557 bp, Homo sapiens
  Payload ID: 15389
  Gene Symbol: SCAMP5
  Gene Name: secretory carrier membrane protein 5
  ENST ID: ENST00000568119
  CDS Start-End: 418-557
ggaaaccggccttctggagatggcgtgcgcagccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggttcaatcaattctcctgcttcaacctcccgagtagctggaactacaggcacatgccaccacgcccagttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgtga

SEQ ID NO: 179558 - DNA, 1142 bp, Homo sapiens
  Payload ID: 15389
  Gene Symbol: SCAMP5
  Gene Name: secretory carrier membrane protein 5
  ENST ID: ENST00000568423
  CDS Start-End: 298-435
gctagtgcgcggtcagcagagtgcgggaggagctggctgcggctccactccgcgcctccccgcgggcgattacgtcgcggcgtggtcctcgcggggcgcggaagacccagacttcagcctcgccacgcctgcccggagctcgaggctcccggacccccgtccacccctgggacgtgaggagtgaggctttgggccaggctgttccccgaggcgcgtggggaagcgggcgtgacctcttctgaaaaggcgttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggttcataaattttaccggggaagtggggggagtttcagcaaagctcaggaggagtggaccacaggggcctggaagaatccacatgtgcagcaggcagcccagaacgcagccatgggggcagcccagggtgccatgaatcagcctcagactcagtattccgccacccccaattacacgtactccaatgagatgtgaaccagccacgcctaccaggtggcagagctggggccattgggacagggggctcaagccacatcgtcatttgtggttaccaagcagggttcccccttcccttttctccttccctactttgtacaaaggaccagagttatatatatatatatatgtatatgtctgtaccccagcccccacctttcagattctgctcttggcactcagctgtgggctgcacgtggagctgtcccgtgcggtagtagctgtgtctgtgtcccctcgtgaaatagtgtgcagtggaggtctcttgtggtg

SEQ ID NO: 179559 - DNA, 532 bp, Homo sapiens
  Payload ID: 15389
  Gene Symbol: SCAMP5
  Gene Name: secretory carrier membrane protein 5
  ENST ID: ENST00000564491
  CDS Start-End: 175-312
tccgcgccgcatcgctcgggtgcagcgcagctcagcgcagcgctgcggcctttcggcagccgaacggccgcggcagaaccccgaccaagaacagatgccgggcccccagtcgctgccccatcaaggttcaggacaaagaggtgtgggcaggccactgggccagctggtaacatcatggcagagaaagtgaacaacttcccaccattgcccaaattcatcccgctgaagccatgtttctaccaagacttcgaggcagatattcctccccagcatgtcagcatgaccaagcgcctctactacctctggatgtgactgacagctccttcagtttcatggcattcttctttaccttcatggctcagttggtcatcagcatcatccaggccgtgggcatcccaggctggggcgtctgcggctggattgctaccatctccttcttcggaacgaacattggctcggcggtggtgatgctaattcccactgtcatgttcacagtgatggccgtcttttccttcatcgccctcagcatggt

SEQ ID NO: 179560 - DNA, 596 bp, Homo sapiens
  Payload ID: 15390
  Gene Symbol: SLPI
  Gene Name: secretory leukocyte peptidase inhibitor
  Uniprot ID: P03973
  ENST ID: ENST00000338380
  CDS Start-End: 22-420
agagtcactcctgccttcaccatgaagtccagcggcctcttccccttcctggtgctgcttgccctgggaactctggcaccttgggctgtggaaggctctggaaagtccttcaaagctggagtctgtcctcctaagaaatctgcccagtgccttagatacaagaaacctgagtgccagagtgactggcagtgtccagggaagaagagatgttgtcctgacacttgtggcatcaaatgcctggatcctgttgacaccccaaacccaacaaggaggaagcctgggaagtgcccagtgacttatggccaatgtttgatgcttaacccccccaatttctgtgagatggatggccagtgcaagcgtgacttgaagtgttgcatgggcatgtgtgggaaatcctgcgtttcccctgtgaaagcttgattcctgccatatggaggaggctctggagtcctgctctgtgtggtccaggtcctttccaccctgagacttggctccaccactgatatcctcctttggggaaaggcttggcacacagcaggctttcaagaagtgccagttgatcaatgaataaataaacgagcctatttctctttgca

SEQ ID NO: 179561 - DNA, 3838 bp, Homo sapiens
  Payload ID: 15391
  Gene Symbol: SHPK
  Gene Name: sedoheptulokinase
  Uniprot ID: Q9UHJ6
  ENST ID: ENST00000225519
  CDS Start-End: 104-1540
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgcggtggccgggccccaggggcgggagcaggatgtgagtagaatcctccaagccctacacgagtgccttgctgcccttccccgaccccagctccggagcgtcgtgggcatcggggtgtcgggccagatgcatggagtcgtgttttggaaaacaggccaaggctgtgaatggacagagggagggattaccccggtgttcgagccccgagctgttagccacctggtcacgtggcaggatggccgatgtagcagcgaattcctggcctctctgccccagccgaagtctcatctcagtgtggccacgggcttcggctgtgcaaccatcttctggcttttgaaatatcgcccagagttcctgaagtcctacgacgcagccggtaccatccacgactatgtggttgccatgctgtgtggcttgccaagacctctgatgtccgaccagaatgctgccagctggggctatttcaacacgcagagccaaagctggaacgtagagacactgaggagctcgggttttcctgtccacctgctcccagacatcgccgagcctggcagtgtggcgggcagaacttcccacatgtggtttgaaatcccaaaggggacgcaggtgggagtggccttgggtgatttacaggcctctgtctattcctgcatggcccagaggacagatgcagttctcaacatcagcacctcggttcagctggcagcctccatgccttcaggattccagcctgcacagactccagaccctacggccccagtcgcctacttcccatacttcaacaggacctacctgggggtggccgcgtcactcaacgggggcaatgtgctggccacgttcgtccacatgctggttcagtggatggcagatctaggcctggaggttgaagaatccactgtgtattcacgcatgattcaggcagctgtgcagcagagagatacccacctgaccatcaccccgacagtgctgggggagaggcacctgccggaccagctggcctcagtgaccagaatctcctcctccgacctctccctggggcacgtgacccgggctctgtgccgaggcattgttcagaacctgcactccatgcttccgattcagcagctccaggagtggggcgtggagagggtgatgggcagtgggagtgcgctgtccaggaatgacgtgctgaagcaggaggtgcagagggctttccctttgcccatgtcctttgggcaggatgtggatgcagctgtcggggcagctctggtcatgctccggagacacctcaaccagaaggaatcttagacagcaaactctttcgccaaacgactgctgtgaattttacctgattaacattcctgacaccatctgtgggtcatcctttccctggaccgttcagtggacagctttcaagcagtgcttgttgtgaggtcccatctcggccaagaacttaccttcagaacatactctaataatgcagccaggagccgtcagccagatcccaaatgagtgccttccgaaattgacccacctgggagctatttacaaatgtccatgtgggagagagagagcatgagagcacagtagcccagcctgctggtcagcaggctcatctgtggttcacctgtagacagagagcagatcaatgtgtacttcagacaccagaaagtctggtggctttggtcccaagtgggaaaagagaactgccccatgcccagcttgtgattatcgtttttggagacctgaagcccacactcgggtcgtatggacttctggaaaagttcttgtctcctggactgaaccatgtgaccggaggcccctttcctagtctcatcctcccctggctgcagatgcttagctgggccagggattgacccaagcgcgatgcagcaggcaggctcagaagacgatgcggggctgtgtgccggccttcttgctgcatgtactcagcctcaggagagcttgctgcacccaggccgcccaggtcttcacagcacaactgcctggaaggcaggttgcgagaaggagaggcggatggcatgagcagcaagggggaccgatgctgtgcagctcacaccactccagaacctgacaaggcaccagcaggaccccttgccaggagcatgtctgtgcagcagtgtttttgcccctgcacattccagaagccctcatgggaagggatgcagccaggcagactcctgccagatggggcaggtagtttattcaaagagaactctgtatcccataggcccaggctctcctttcgcttggcgtgggctttgctggcccagtgtgtgctcctggctcagcagaaacatccatttgagttggcatccctgtagggatcccagagcgttgtaagccttcttgtgattggtagggatggctgtggggtggcttccaggagggggccaccattgccgcatctacttctagactcccaaaggagcccaggctcaggcaggcctggcccagagtcacgctggcaaccacgagtttgggaagcagtcgtattctctctctctctctctctctctctctcagtatccatgacaggtatgaaacatattgtctctttataaatgtcattttacaaattatgtgattatctggaagctctaagatgagagcaaatgcctgatcactctggccaaatgtcagatactaaagcccattcttggccgggcatgttggctcccgcctgtaatcccagcactttgggaagcccaagtgggtgaatcacctgaggtcaggagttcaagaccagcctgaccaacatggggataccccgtctctactaaaaatacaagccgggcgtggtggcgcatgcctgtaatcccagctactcaggaggctgaggcaggaaaatcacttgaactcgggaggcagaggttgcagtgagctgagatcgcgccattgcactccagcctgggtgacagagcaagactctgtctcataaataaatacaaagcccattcttccagagtcttgtgccttaaataaaacacacctctctgctgtgggaagactgtgcaatggcacagccgcagagcttggtttgggaggttgaagtgctctggggagaattcgtagatcatcctcagaaaagccttgccctggtgttctaccagaaaaacgtctcccaatcacccaggaaagctgtccacagtagtccccccttatccacggtgtcactttccatgggttcagttatctgcggtcaaccacggtctgacaatattaaatggaaaattcttcaaacagttcccaagttttcccttgtgcattgttctgagcagtgtgatggagagtctctgccgtgccatctgggatgcaaaccgtccctgtgttccccacgtccaggccgtagatgctccccgccggtcagtcacttagtcgtcagatcgcccgtcctggtatcacagtgcttctgttcaggtcagtctttttttacttcattagggccccaaagcaccagagtagtgatgctggtagtgatgctggctgttcggatatgccaaagagaaaccgtaaggtgcttcctttaagtgaaaagatgggaagaaaacagtcatatgctgaatcttctatctgtgaaattct

SEQ ID NO: 179562 - DNA, 3494 bp, Homo sapiens
  Payload ID: 15392
  Gene Symbol: SEH1L
  Gene Name: SEH1-like nucleoporin
  Uniprot ID: Q96EE3
  ENST ID: ENST00000262124
  CDS Start-End: 128-1210
gtgcgggggcgtgggcagcacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcagaaagcacagctgagtacaagctaactggagtaactttgctgttttgctgcttgttgcatgcacacaggaatggaaagcgagctccttttccccttccccagcgccgtttgacctctcccaagatacaccagcagcctgcttactactaaacgcaatccaaaaggcctttaaaaatacagtgtatattttttgtactagtcagtttattgacactatttgaaacttttgaaatataaacggagaggctttctgttgagacattgtcaccaaaacaattttttgaaatgttcctgaaactaatttgggtttaaagattaaaagggttgttaccattcttatctgagtagttgggaggaggggaataccactttagttcatttggaaaatatagacatatttcttttgctttcttaaaacagcttaaaatgatgaacttttataattttaatttgaagattgaataaatattttttataaagattgttttgagtgctgatttgtttactttttgtagatttgctttatccatgatattcagtacaactctgtcatttctttgtaatatttaaaaaatattagtaaaggagtgaattaataaagtagtaatagtaaaatgaaaggaacttgactgtacagtttgtagccaggttaagcatttggtattgtttcatttacaatttgggactaagatggaaacactttttttataagtttttaattcatagtcactaaagagataaatgtttcttatatacatttgtgtatttttatggtgttatttattccatggcttagcttccttcaaatcaaaatttggacacacactattaagagaagccattaaaattttactaaaattgtgcatgtaaattaattgtcagcattccatgtctcaagattttcttaatttagttcgctgtttaaattaattcatgtcctgtaaagttctgaccttgataacaaagctataaatatttaagtttgctaatatgcgtaagtattatcggtaagttacaagatggaagaagaataacagtagggcacagtcattctgtgaatccttttacttatcaaaatttggtagctattctaaggcttttgcagaaaaataagtgttcaatgtttgtagttcttcaaaagcatgttgcagtagccagccatactatgtgtattcccagtatcatgtacgcactaaaaaaaatgtgtgcttgctgctgctgtgagtgaaccattgcttaagataaaaaacttaactagatctgtaaatgtacagaatagcatcagatgtttctgagagattagaaaatgttttgaatttataaaattaatgtttttctttgtaacatttatatatattttttaacattttaagtttaacagattgtattcctttcaagtttctatacttgcttaagcaatcttgatttgagtaagggtcttgatttgtgctattatgttctgttagttttggcatgaatatactaaagcttttttttttttttctagcatgtgttttctcctctttggttctctttgtatttactacttttctctttttcttgtgttttttttttcctgtttttgttttgtttggtgttttgttcctgtcttcattgtttcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaa

SEQ ID NO: 179563 - DNA, 1846 bp, Homo sapiens
  Payload ID: 15392
  Gene Symbol: SEH1L
  Gene Name: SEH1-like nucleoporin
  Uniprot ID: Q96EE3
  ENST ID: ENST00000399892
  CDS Start-End: 102-1367
gtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaagatgtgagaatttttacattaaagcctgtgaggaaagaactgacttcctctggtgggccaacaaagtttgaaatccatatagtggctcagttcgataatcataattctcaggtctggcgagtgagttggaatataacaggaacggtgctagcatcttcaggagatgatgggtgtgtaagattgtggaaagctaattatatggacaattggaagtgtactggtattttgaaaggtaatgggagcccagtcaatgggagttctcagcagggaacctcaaatccttccctaggttcaactattccaagtcttcagaattcattaaatggatcttctgctggcaggtatttctttacccctctggattccccacgggctggatcgagatggtccagttatgcccagctccttcctcctcctcctcctcctctggtagagcactcttgcgatgctgacactgccaacctccagtatcctcaccctcgcagacgatatctctctcggcctcttaatcccttacctgagaatgaagggatttaaaacactgatttaacattgaaaggccttattcaagtgcttgtaaatgctttcatttctggctgctttttgtttttcattttctttcagaagatttttctaacttagggtctgtcttgcatgtattacaaccagaatacagtgtttggaacctaaatctgtttgtgcgtctgcatcaaaggaacatttgcttcactgggtgataacctttgatgaaatgagatatgtccaagtaacgttaactgtgaagttacacacagtagctgacttcaaagtgcctgttctgtaaattttattttaaactgttaccatagtcttaagttgtttatgctttatcagactggctaatgtgaaagcataatattatgaagtttattctgccttatgagaccttaaaaaatggatttcattttacaggctaatgttgtaactgactagtatgtaaaataaatcattcctgtgtataaagcagcaaaacctaa

SEQ ID NO: 179564 - DNA, 863 bp, Homo sapiens
  Payload ID: 15392
  Gene Symbol: SEH1L
  Gene Name: SEH1-like nucleoporin
  ENST ID: ENST00000587761
  CDS Start-End: 75-863
taggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagaatatccaaactgatagaaaagatgaatagagcacatttatacaacttccacatcccaagctctcgtgctcattcccccatgatcgccgtaggaagtgatgacagtagccccaacgcaatggccaaggttcagatttttgaatataatgaaaacaccaggaaatatgcaaaagctgaaactcttatgacagtcactgatcctgttcatgatattgcattcgctccaaatttgggaagatctttccatattctagcaatagcgaccaaa

SEQ ID NO: 179565 - DNA, 582 bp, Homo sapiens
  Payload ID: 15392
  Gene Symbol: SEH1L
  Gene Name: SEH1-like nucleoporin
  ENST ID: ENST00000585730
  CDS Start-End: 109-582
acaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaaggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccagg

SEQ ID NO: 179566 - DNA, 655 bp, Homo sapiens
  Payload ID: 15392
  Gene Symbol: SEH1L
  Gene Name: SEH1-like nucleoporin
  ENST ID: ENST00000589446
  CDS Start-End: 87-655
gcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactgggttaaaaggacaactctggtggatagcagaacatctgttactgatgtgaagtttgctcccaagcacatgggtcttatgttagcaacctgttccgcagatggtatagtaagaatctatgaggcaccagatgttatgaatctcagccagtggtctttgcagcatgagatctcatgtaagctaagctgtagttgtatttcttggaacccttcaagctctcgtgctcattcccccatgatcgccgtaggaagtgatgacagtagccccaacgcaatggccaaggttcagatttttgaatataatgaaaacaccag

SEQ ID NO: 179567 - DNA, 787 bp, Homo sapiens
  Payload ID: 15392
  Gene Symbol: SEH1L
  Gene Name: SEH1-like nucleoporin
  ENST ID: ENST00000592170
  CDS Start-End: 556-787
ttttccccggaggactctggctcccgggtagcaagcagcccacttccccggccgcttccttcccccgggatgacacgtttctacaggcggactcttctaattcatactatttccctacccccgtggtggctcctagcacccccaggcctgttctacctgtaaaatcttgacacatttaaactactacttctgatcctttcctccccgtccagccttcgctcttaggctgccgagcctggactgcttgtcatcccctcaggcgtctccccggccctccctgctcttcagccgtcccgacggagcgcggctcctgaccaaacccacggttcgtcttctccacctgctccgcgcgcctcgcatgtgtctggggggaaacacatccaaacgtcgacttaaatgattcagggccgaggaccgtgagaggcagtcttcactttttcatctttcttcatttgcacagtataccaataagctcttactacttctcagcacagcatcgcggcggaccacaaggatctcatccacgatgtctctttcgacttccacgggcggcggatggcaacctgctccagcgatcagagcgttaaggtctgggataaaagtgaaagtggtgattggcattgtactgctagctggaagacacatagtggatctgtatggcgtgtgacatgggcccatcctgaatttgggcaggttttggcttcctgttcttttgaccgaacagctgctgtatgggaagaaatagtaggagaatcaaatgataaactgcgaggacagagccactggg

SEQ ID NO: 179568 - DNA, 4471 bp, Homo sapiens
  Payload ID: 15393
  Gene Symbol: SEZ6
  Gene Name: seizure related 6 homolog (mouse)
  Uniprot ID: Q53EL9
  ENST ID: ENST00000317338
  CDS Start-End: 430-3414
agaaggctacagtgagctattaattgaggttccttagcaggccgttaacgggaaagagggtggcatgcttggctgggggtgggcagcgcagaagggcaggggccgtgtgcccacatgagtagggcagtcgcggtggagcgggagcctgggctcctgcccctgggtctctgcgcctttgcatgagactttacggtaagccgctcctcccgcgcccccgcccccagccccgctcggcgatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaa

SEQ ID NO: 179569 - DNA, 4195 bp, Homo sapiens
  Payload ID: 15393
  Gene Symbol: SEZ6
  Gene Name: seizure related 6 homolog (mouse)
  ENST ID: ENST00000335960
  CDS Start-End: 180-3164
cgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcggtgagtgcccaggggtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatggttctacaacagtcgcagcctggatggttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggatctctttcctttgcaggagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttgg

SEQ ID NO: 179570 - DNA, 4306 bp, Homo sapiens
  Payload ID: 15393
  Gene Symbol: SEZ6
  Gene Name: seizure related 6 homolog (mouse)
  Uniprot ID: Q53EL9
  ENST ID: ENST00000360295
  CDS Start-End: 277-3258
ctgcccctgggtctctgcgcctttgcatgagactttacggtaagccgctcctcccgcgcccccgcccccagccccgctcggcgatccccggcgccgtcgccaggcgctggccgtggtgctgattctgtcaggcgctggcggcggcagcggcggtgacggctgcggccccgctccctctacccggccggacccggctctgcccccgcgcccaagccccaccaagccccccgccctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaagcaa

SEQ ID NO: 179571 - DNA, 3805 bp, Homo sapiens
  Payload ID: 15393
  Gene Symbol: SEZ6
  Gene Name: seizure related 6 homolog (mouse)
  ENST ID: ENST00000442608
  CDS Start-End: 45-2987
ctcccgccgcggtcccagcccagggcgcggccgcaaccagcaccatgcgcccggtagccctgctgctcctgccctcgctgctggcgctcctggctcacggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggaggg

SEQ ID NO: 179572 - DNA, 3804 bp, Homo sapiens
  Payload ID: 15393
  Gene Symbol: SEZ6
  Gene Name: seizure related 6 homolog (mouse)
  ENST ID: ENST00000540632
  CDS Start-End: 1-2760
gaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggccttccagcagggccattgctatgagccctttgtcaaatacggtaacttcagcagcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaaa

SEQ ID NO: 179573 - DNA, 807 bp, Homo sapiens
  Payload ID: 15393
  Gene Symbol: SEZ6
  Gene Name: seizure related 6 homolog (mouse)
  ENST ID: ENST00000535262
  CDS Start-End: 1-304
cctggatgctgcccacattgcagctgccatcttcttgccactggtggcgatggtgttgttggtaggaggtgtatacttctacttctccaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggaggg

SEQ ID NO: 179574 - DNA, 3468 bp, Homo sapiens
  Payload ID: 15393
  Gene Symbol: SEZ6
  Gene Name: seizure related 6 homolog (mouse)
  ENST ID: ENST00000540419
  CDS Start-End: 1-1364
caggggagatagccagcactacaccccccagcagagcctggacaccaacccaagagggtcctggagacatgggaaggccgtgggttgcagaggttgtgtcccagggcgcagggatcgggatccaggggaccatcacctcctccacagcttcaggagatgatgaggagaccaccactaccaccaccatcatcaccaccaccatcaccacagtccagacaccaggcccttgtagctggaatttctcaggcccagagggctctctggactcccctacagacctcagctcccccactgatgttggcctggactgcttcttctacatctctgtctaccctggctatggcgtggaaatcaaggtccagaatatcagcctccgggaaggggagacagtgactgtggaaggcctgggggggcctgacccactgcccctggccaaccagtctttcctgctgcggggccaagtcatccgcagccccacccaccaagcggccctgaggttccagagcctcccgccaccggctggccctggcaccttccatttccattaccaagcctatctcctgagctgccactttccccgtcgtccagcttatggagatgtgactgtcaccagcctccacccagggggtagtgcccgcttccattgtgccactggctaccagctgaagggcgccaggcatctcacctgtctcaatgccacccagcccttctgggattcaaaggagcccgtctgcatcgctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgaggcagcacacccacctaccctgtgggtaccactgtggagttcagctgcgaccctggctacaccctggagcagggctccatcatcatcgagtgtgttgacccccacgacccccagtggaatgagacagagccagcctgccgagccgtgtgcagcggggagatcacagactcggctggcgtggtactctctcccaactggccagagccctacggtcgtgggcaggattgtatctggggtgtgcatgtggaagaggacaagcgcatcatgctggacatccgagtgctgcgcataggccctggtgatgtgcttaccttctatgatggggatgacctgacggcccgggttctgggccagtactcagggccccgtagccacttcaagctctttacctccatggctgatgtcaccattcagttccagtcggaccccgggacctcagtgctgggctaccagcagggcttcgtcatccacttctttgaggtgccccgcaatgacacatgtccggagctgcctgagatccccaatggctggaagagcccatcgcagcctgagctagtgcacggcaccgtggtcacttaccagtgctaccctggctaccaggtagtgggatccagtgtcctcatgtgccagtgggacctaacttggagtgaggacctgccctcatgccagagggtgacttcctgccacgatcctggagatgtggagcacagccgacgcctcatatccagccccaagtttcccgtgggggccaccgtgcaatatatctgtgaccagggttttgtgctgatgggcagctccatcctcacctgccatgatcgccaggctggcagccccaagtggagtgaccgggcccctaaatgtctcctggaacagctcaagccatgccatggtctcagtgcccctgagaatggtgcccgaagtcctgagaagcagctacacccagcaggggccaccatccacttctcgtgtgcccctggctatgtgctgaagggccaggccagcatcaagtgtgtgcctgggcacccctcgcattggagtgaccccccacccatctgtagggctgcctctctggatgggttctacaacagtcgcagcctggatgttgccaaggcacctgctgcctccagcaccctggatgctgcccacattgcagctgccatcttcttgccactggtggcgatggtgttgttggtaggaggtgtatacttctacttctccaggctccagggaaaaagctccctgcagctgccccgcccccgcccccgcccctacaaccgcattaccatagagtcagcgtttgacaatccaacttacgagactggagagacgagagaatatgaagtctccatctaggtgggggcagtctagggaagtcaactcagacttgcaccacagtccagcagcaaggctccttgcttcctgctgtccctccacctcctgtatataccacctaggaggagatgccaccaagccctcaagaagttgtgcccttccccgcctgcgatgcccaccatggcctattttcttggtgtcattgcccacttggggcccttcattgggcccatgtcagggggcatctacctgtgggaagaacatagctggagcacaagcatcaacagccagcatcctgagcctcctcatgccctggaccagcctggaacacactagcagagcaggagtacctttctccacatgaccaccatcccgccctggcatggcaacctgcagcaggattaacttgaccatggtgggaactgcaccagggtactcctcacagcgccatcaccaatggccaaaactcctctcaacggtgacctctgggtagtcctggcatgccaacatcagcctcttgggaggtctctagttctctaaagttctggacagttctgcctcctgccctgtcccagtggaggcagtaattctaggagatcctaaggggttcagggggaccctacccccacctcaggttgggcttccctgggcactcatgctccacaccaaagcaggacacgccattttccactgaccaccctataccctgaggaaagggagactttcctccgatgtttatttagctgttgcaaacatcttcaccctaatagtccctcctccaattccagccacttgtcaggctctcctcttgaccactgtgttatgggataaggggagggggtgggcatattctggagaggagcagaggtccaaggacccaggaatttggcatggaacaggtggtaggagagccccagggagacgcccaggagctggctgaaagccactttgtacatgtaatgtattatatggggtctgggctccagccagagaacaatcttttatttctgttgtttccttattaaaatggtgtttttggaaaaaaaaaaaaaaaaaaaaaaaaa

SEQ ID NO: 179575 - DNA, 601 bp, Homo sapiens
  Payload ID: 15393
  Gene Symbol: SEZ6
  Gene Name: seizure related 6 homolog (mouse)
  ENST ID: ENST00000539265
  CDS Start-End: 1-395
ctgcttgcggcggagtgatccgcaatgccaccaccggccgcatcgtctctccaggcttcccgggcaactacagcaacaacctcacctgtcactggctgcttgaggctcctgagggccagcggctacacctgcactttgagaaggtttccctggcagaggatgatgacaggctcatcattcgcaatggggacaacgtggaggccccaccagtgtatgattcctatgaggtggaatacctgcccattgagggcctgctcagctctggcaaacacttctttgttgagctcagtactgacagcagcggggcagctgcaggcatggccctgcgctatgagggtgagcctgctggggcctcactgggggtggcgggtccacggggatgggctcgggcctagggtctttctcccacaccctacccctctctgcctccatgctgtcactccttccaagtcagcccctgctcactcagtacttaggccccctttccctgcccctctctttgggtccgggatccctaccacagctttgcaggaaacctctgcctggacccaggccctatggtccaagggaataaattctccagattttgaaaagcaaaaaa

SEQ ID NO: 179576 - DNA, 575 bp, Homo sapiens
  Payload ID: 15393
  Gene Symbol: SEZ6
  Gene Name: seizure related 6 homolog (mouse)
  ENST ID: ENST00000585644
  CDS Start-End: 406-575
aagacggaactgccacaagggcacgcgggcctcaccagctgcctcactctcggatgtcttcccaggtcacccttgacgccctcaggactctctttagaggccccaaccgtggggaaaggacaagccccaggcatcgaggagacagatggcgagctgacagcagcccccacacctgagcagccagaacgaggcgtccactttgtcacaacagcccccaccttgaagctgctcaaccaccacccgctgcttgaggaattcctacaagaggggctggaaaagggagatgaggagctgaggccagcactgcccttccagcctgacccacctgcacccttcaccccaagtccccttccccgcctggccaaccaggacagccgccctgtctttaccagccccactccagccatggctgcggtacccactcagccccagtccaaggagggaccctggagtccggagtcagagtcccctatgcttcgaatcacagctcccctacctccagggcccagcatggcagtgcccaccctaggcccaggggagatagccagcactacaccccccagcagagcctggac

SEQ ID NO: 179577 - DNA, 3248 bp, Homo sapiens
  Payload ID: 15394
  Gene Symbol: SEZ6L
  Gene Name: seizure related 6 homolog (mouse)-like
  Uniprot ID: Q9BYH1
  ENST ID: ENST00000248933
  CDS Start-End: 96-3170
gcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggca

SEQ ID NO: 179578 - DNA, 2898 bp, Homo sapiens
  Payload ID: 15394
  Gene Symbol: SEZ6L
  Gene Name: seizure related 6 homolog (mouse)-like
  Uniprot ID: Q9BYH1
  ENST ID: ENST00000343706
  CDS Start-End: 13-2859
cctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgttttagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaacc

SEQ ID NO: 179579 - DNA, 6307 bp, Homo sapiens
  Payload ID: 15394
  Gene Symbol: SEZ6L
  Gene Name: seizure related 6 homolog (mouse)-like
  Uniprot ID: Q9BYH1
  ENST ID: ENST00000360929
  CDS Start-End: 157-3006
cgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaacggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaaga

SEQ ID NO: 179580 - DNA, 3306 bp, Homo sapiens
  Payload ID: 15394
  Gene Symbol: SEZ6L
  Gene Name: seizure related 6 homolog (mouse)-like
  ENST ID: ENST00000402979
  CDS Start-End: 743-3133
aaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtg

SEQ ID NO: 179581 - DNA, 3444 bp, Homo sapiens
  Payload ID: 15394
  Gene Symbol: SEZ6L
  Gene Name: seizure related 6 homolog (mouse)-like
  Uniprot ID: Q9BYH1
  ENST ID: ENST00000404234
  CDS Start-End: 197-3268
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagttaatcaagacagttttgaacatgctttagaagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaa

SEQ ID NO: 179582 - DNA, 3078 bp, Homo sapiens
  Payload ID: 15394
  Gene Symbol: SEZ6L
  Gene Name: seizure related 6 homolog (mouse)-like
  ENST ID: ENST00000403121
  CDS Start-End: 743-2905
aaaggaagggagggagggagaaaggagaagttggtttagaggccagccggacgagctttgggcaccgcccttaggagggccaccctcagagtctgacagcaggtgaaggtcctaaatctccccaaactaactggtgtcttttctcctcttccaagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtg

SEQ ID NO: 179583 - DNA, 6534 bp, Homo sapiens
  Payload ID: 15394
  Gene Symbol: SEZ6L
  Gene Name: seizure related 6 homolog (mouse)-like
  ENST ID: ENST00000529632
  CDS Start-End: 197-3232
gcgcccggcgcagctcggccagagcgaccgcggggctgagcgcgcgtccgcccagggggctccggaagctgccccggcccgcggcctcctccctcgctcccgcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggcacttgattgaaaccccagaatgtcgactgtcttttgtttagactctttatcaaaggtttactgttttcttccctgtatttattatatttaaaagtgaaataggtgtgggtttggatgtttcgcggcctcagccaaattcatgttacagcctcaattctgaaggcaggtggaagacttgcaaaatggcaaaccgcggcagcaaaaacacaaaacagcagatggagtttctcccatcagcaatgccatgctaaggctgcattgaattgcatgcatctttgggaaccatgcccatgatgttttcagtacaaatctaagtcccaagattaggttggaaagggtatttcttgttggcttagtttgggttggaatttagcatgggtacttaaacccatttggagagctgtgctcctaaacaaattctgtgtcctctcttcccattttgccagcttctgaaaggtttttccacagcccctccctctcacggttcttctgaaggtagcaaaggtgttatataaacattgtcttttaccactctggcctcgctggacagtgacaaaacaagaaaacgttttctttctagaaaggtgataaacgaccaaaggcaatttttcagagacaaatgagagatttgagagttccaatgaagaattgggtgagggggatcattgggtaagggaattgggttaaaatgttcttttctttgacactctttcaatgatgaaagagcgtgtaatttatgctacaagtgccagaatcgatcaccatgttcagcaagccactctcaagctgtggtaataaacacacaggcttgggaggcaccagcggccccactcatacagtgacaaggatttgtgatgggaaaaaggaggtgccatgtttggaaatgcaggggtgagctctggtttctcctggggttctggaatatctcagccctcaaaatagaggagactcaagtgcactgattctctaaaaggtgtcatcttcagaatatacttgccatcaagtatttcagggggcgggagggtcccatgagaagaaactatttttctattctccaaagctgtctggatgttggagggtggtgtgaatgctgactgaggaggtgcagagaacaggggcaggggattttaaatcacagcagaccatccagtggaatcctgtatcatctgatctgaacatcaatgaagacagagagaggaatttcattcagaaaggattccatagccccacatctagtcacacgggcattcctcttattttatcagggtctgttttcccccaacccagtgaaaccggtgagtgtgtaactcttgggaagattcttttctaaatacaggtataaagagaaggtggagggtgcgggtgcatggaagaaatactatgtgtgaagcagattcaccttcctgggaccggtgacatggtggtgacagtcaatggcttggacagacagacgggcacagtggcatttggaaccctctttggtgccctcccattctctctggaattgtttcaagtctgctggttttcaaacaagaaaagacctttctggccatagggagaatagcagggagtctatgttttggtggttacattggaaacatcttaagcaagatagggaaagttgattttaggcacacatgtaccctccttgacagcaggaactcagacttcaatcttgggggtctaagaccagaatattttccttctgccagaaaagaatcttgcacatatactcctgaaggcatgagtgtgtggtccatggcaagaaatagctaaaggctgctttccaggacccaaagccccatttaatgcaagaaccagagaagtgttctaggccattagtggacaatgtcatgtttggagaaagataacaacacaaataatgtaacctttccttaaaaggcagaactcaatccattttatttgatgcttattctaaccctaaccctgggtcacctggaatgaagaactctatgaataatatttgattttacaacgtgttatggttatgtgaaaactaaacatttgccttttataaagactgacaaaatataaatctttattctaaccctatccccaaaactagccaggccacaccccagatgttcttattgactattggaaagatagaaaaggcgttgtgttttttgtttttttgttgttgttgtcattgttgtttttttcagaagaccagtgtctcagttctgtcttagtagtaccacacccgtaaccgtgttttaaaagtttgttttagcctagagacagatcatacgagttcaacaatgtacagtgtgattgaaaagacaggttggtgtctatttttctttttaaaatatctgaatgtgtatttgtaatacgtaaaggtaaaaaaaaatagtgccaaaaatgtgcaaggcatctcattacagctcatgtacgtctgtttttataagatcaatattaaaacccattgggattaaatatttttgaataggatacactcttgagaaactcgagaatggactgagccttcctacaagccactctttgtttttaaaacagtggggaaatacgtttacagagattgtgagcttcagagaatgcatgtgatggtgtgtattacatgctaattcatataagctgtatctgtcagctaccaccctgtgctttaaaaatgcacacactcaaccctctttagcttggagctcagctttttgcttttttttttttttttttgtagaattatttagctaacataagtattctgattgctacctgatggccattcttacttagtttcatagatgtgctttaactatgatcctttgaagctcaccccttggagagcctacagaacctcaggctgatagctttgaagactgccaaacagcccagaaggaagcaaagcatctgcataatcaggagggttgtataacaagtagtgatttggcaaatatgtgggtagctttaggctgaggcacgggcctcaggcaaaaatgcccttcgagtgaatccgaagggcatgatcttcctatgtccttgactaggcatgacgagtcatttgaggtcagatattatttgagttgttcagcacccccaaaggtaggcattctcctgggaaattttcatttccattttatcgccaaacaaaataaaaagcaaaacaaactttctaagctagaataatgaaattaagtcattttccactttgtatatattgatgctaataaaacagatgaaaaagac

SEQ ID NO: 179584 - DNA, 3215 bp, Homo sapiens
  Payload ID: 15394
  Gene Symbol: SEZ6L
  Gene Name: seizure related 6 homolog (mouse)-like
  Uniprot ID: Q9BYH1
  ENST ID: ENST00000629590
  CDS Start-End: 96-3137
gcttcccctttctcgctcaccgccgccctccttccccagctccctcgccgtccgcccgccccacagccagcggctccgcgccccctgcagccacgatgcccgcggcccggccgcccgccgcgggactccgcgggatctcgctgttcctcgctctgctcctggggagcccggcggcagcgctggagcgagatgctcttcccgagggagatgctagccctttgggtccttacctcctgccctcaggagccccggagagaggcagtcctggcaaagagcaccctgaagagagagtggtaacagcgccccccagttcctcacagtcggcggaagtgctgggcgagctggtgctggatgggaccgcaccctctgcacatcacgacatcccagccctgtcaccgctgcttccagaggaggcccgccccaagcacgccttgccccccaagaagaaactgccttcgctcaagcaggtgaactctgccaggaagcagctgaggcccaaggccacctccgcagccactgtccaaagggcagggtcccagccagcgtcccagggcctagatctcctctcctcctccacggagaagcctggcccaccgggggacccggaccccatcgtggcctccgaggaggcatcagaagtgcccctttggctggaccgaaaggagagtgcggtccctacaacacccgcacccctgcaaatctcccccttcacttcgcagccctatgtggcccacacactcccccagaggccagaacccggggagcctgggcctgacatggcccaggaggccccccaggaggacaccagccccatggccctgatggacaaaggtgagaatgagctgactgggtcagcctcagaggagagccaggagaccactacctccaccattatcaccaccacggtcatcaccaccgagcaggcaccagctctctgcagtgtgagcttctccaatcctgaggggtacattgactccagcgactacccactgctgcccctcaacaactttctggagtgcacatacaacgtgacagtctacactggctatggggtggagctccaggtgaagagtgtgaacctgtccgatggggaactgctctccatccgcggggtggacggccctaccctgaccgtcctggccaaccagacactcctggtggaggggcaggtaatccgaagccccaccaacaccatctccgtctacttccggaccttccaggacgacggccttgggaccttccagcttcactaccaggccttcatgctgagctgcaactttccccgccggcctgactctggggatgtcacggtgatggacctgcactcaggtggggtggcccactttcactgccacctgggctatgagctccagggcgctaagatgctgacatgcatcaatgcctccaagccgcactggagcagccaggagcccatctgctcagctccttgtggaggggcagtgcacaatgccaccatcggccgcgtcctctccccaagttaccctgaaaacacaaatgggagccaattctgcatctggacgattgaagctccagagggccagaagctgcacctgcactttgagaggctgttgctgcatgacaaggacaggatgacggttcacagcgggcagaccaacaagtcagctcttctctacgactcccttcaaaccgagagtgtcccttttgagggcctgctgagcgaaggcaacaccatccgcatcgagttcacgtccgaccaggcccgggcggcctccaccttcaacatccgatttgaagcgtttgagaaaggccactgctatgagccctacatccagaatgggaacttcactacatccgacccgacctataacattgggactatagtggagttcacctgcgaccccggccactccctggagcagggcccggccatcatcgaatgcatcaatgtgcgggacccatactggaatgacacagagcccctgtgcagagccatgtgtggtggggagctctctgctgtggctggggtggtattgtccccaaactggcccgagccctacgtggaaggtgaagattgtatctggaagatccacgtgggagaagagaaacggatcttcttagatatccagttcctgaatctgagcaacagtgacatcttgaccatctacgatggcgacgaggtcatgccccacatcttggggcagtaccttgggaacagtggcccccagaaactgtactcctccacgccagacttaaccatccagttccattcggaccctgctggcctcatctttggaaagggccagggatttatcatgaactacatagaggtatcaaggaatgactcctgctcggatttacccgagatccagaatggctggaaaaccacttctcacacggagttggtgcggggagccagaatcacctaccagtgtgaccccggctatgacatcgtggggagtgacaccctcacctgccagtgggacctcagctggagcagcgaccccccattttgtgagaaaattatgtactgcaccgaccccggagaggtggatcactcgacccgcttaatttcggatcctgtgctgctggtggggaccaccatccaatacacctgcaaccccggttttgtgcttgaagggagttctcttctgacctgctacagccgtgaaacagggactcccatctggacgtctcgcctgccccactgcgtttcggaggagtccctggcatgtgacaacccagggctgcctgaaaatggataccaaatcctgtacaagcgactctacctgccaggagagtccctcaccttcatgtgctacgaaggctttgagctcatgggtgaagtgaccatccgctgcatcctgggacagccatcccactggaacgggcccctgcccgtgtgtaaagtagcagaagcggcagcagagacgtcgctggaaggggggaacatggccctggctatcttcatcccggtcctcatcatctccttactgctgggaggagcctacatttacatcacaagatgtcgctactattccaacctccgcctgcctctgatgtactcccacccctacagccagatcaccgtggaaaccgagtttgacaaccccatttacgagacaggggaaaccagagagtatgaggtttctatctaaagagagctacacttgagaaggggacttgtgaactcaaccacaatctcctcgagacattcatccagagaccatgtggca

SEQ ID NO: 179585 - DNA, 3173 bp, Homo sapiens
  Payload ID: 15395
  Gene Symbol: SEZ6L2
  Gene Name: seizure related 6 homolog (mouse)-like 2
  Uniprot ID: Q6UXD5
  ENST ID: ENST00000350527
  CDS Start-End: 72-2633
cggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 179586 - DNA, 3801 bp, Homo sapiens
  Payload ID: 15395
  Gene Symbol: SEZ6L2
  Gene Name: seizure related 6 homolog (mouse)-like 2
  Uniprot ID: Q6UXD5
  ENST ID: ENST00000308713
  CDS Start-End: 529-3261
agcttctccctcccgcagctccagtgcccgagcttcggctctcccagttccccaacccaccccttcccctccccgacaagccccgctagagcccagtggagaccccctcgatcctcgaccccaccctaaacccccagaagctgtctttctcctccccagtcccctagcttggggtccagacagcccagtggacccaggcgcctgagcaggagggtaacccaggccacccggccccttcggccctctcggccccaccccctgcagccggagccgcgccccctccaccacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 179587 - DNA, 3015 bp, Homo sapiens
  Payload ID: 15395
  Gene Symbol: SEZ6L2
  Gene Name: seizure related 6 homolog (mouse)-like 2
  Uniprot ID: Q6UXD5
  ENST ID: ENST00000346932
  CDS Start-End: 46-2475
gattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgtaa

SEQ ID NO: 179588 - DNA, 3423 bp, Homo sapiens
  Payload ID: 15395
  Gene Symbol: SEZ6L2
  Gene Name: seizure related 6 homolog (mouse)-like 2
  Uniprot ID: Q6UXD5
  ENST ID: ENST00000537485
  CDS Start-End: 246-2885
accacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 179589 - DNA, 909 bp, Homo sapiens
  Payload ID: 15395
  Gene Symbol: SEZ6L2
  Gene Name: seizure related 6 homolog (mouse)-like 2
  ENST ID: ENST00000563118
  CDS Start-End: 1-909
tctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcct

SEQ ID NO: 179590 - DNA, 332 bp, Homo sapiens
  Payload ID: 15395
  Gene Symbol: SEZ6L2
  Gene Name: seizure related 6 homolog (mouse)-like 2
  ENST ID: ENST00000568380
  CDS Start-End: 91-332
aattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgacccc

SEQ ID NO: 179591 - DNA, 3555 bp, Homo sapiens
  Payload ID: 15395
  Gene Symbol: SEZ6L2
  Gene Name: seizure related 6 homolog (mouse)-like 2
  ENST ID: ENST00000617533
  CDS Start-End: 246-3017
accacagagccgcgagaagaggacagaggagactgagcaaaggggggtgggctccaggcgacccctagcccaattctgcccctccatcccaaggggcagagaaattgtctttctttgctgactcctacgaggaaaaaaaaaaaaaaaaaaaaaacaattaaagggaaagataaacggagacggaggaaaggtggcagccagattacttagagaggcacagaggagagagatcggggtgagtcgccatggggactcccagggcccagcacccgccgcctccccagctgctgttcctaattctgctgagctgtccctggatccagggtctgcccctgaaggaggaggagatattgccagagcctggaagtgagacccccacggtggcctctgaggccctggctgaactgcttcatggggccctgctgaggaggggcccagagatgggctacctgccaggatctgatcgggaccccacgctagccacccctccggccggccagactctcgcagtgccctccctgccacgggccactgagccggggacagggcctctgacaacagccgtcacccctaacggggtcaggggggcaggccccactgcgccagaactgctgaccccgcccccaggaaccacagccccacccccacccagccctgcctccccagggcctccccttgggcctgagggaggagaggaggagacgacgaccaccatcatcaccacgacaactgttaccactacggtgaccagcccagttctgtgtaataacaacatctccgagggcgaagggtatgtggagtctccagatctggggagccccgtcagccgcaccctggggctcctggactgcacttacagcatccatgtctaccctggctacggcattgagatccaggtgcagacgctgaacctgtcacaggaagaggagctcctggtgctggctggtgggggatccccaggcctggccccccgactcctggccaactcatccatgcttggagaaggacaagtccttcggagcccaaccaaccggctgcttctgcacttccagagcccacgggtcccaaggggcggtggcttcaggatccactatcaggcctacctcctgagctgtggcttccctccccggccggcccatggggacgtgagtgtgacggacctgcaccctgggggcactgccacctttcactgtgattcgggctaccagctgcagggagaggagaccctcatctgcctcaatggcacccggccatcctggaacggtgaaacccccagctgcatggcatcctgtggtggcaccatccacaatgccaccctgggccgcatcgtgtccccagagcctgggggagccgtagggcccaacctcacctgccgttgggtcattgaagcagctgaggggcgccggctgcacctgcactttgaaagggtctcgctggatgaggacaatgaccggctgatggtgcgctcagggggcagccccctatcccccgtgatctatgattcggacatggacgatgtccccgagcggggtctcatcagtgacgcccagtccctctacgtggagctgctgtcagagacacctgccaatcccctgctgttaagccttcgatttgaagcctttgaggaggatcgctgcttcgcccccttcctggcacatggaaatgtcactaccacggaccctgagtatcgcccaggggcactggcaaccttctcgtgcctcccaggatatgccctggagccccctgggccccccaatgccatcgaatgtgtggatcccacagaaccccactggaacgacacagagccggcctgcaaagccatgtgtggaggggagctgtcggaaccagctggcgtggtcctctctcccgactggccccagagctatagcccgggccaagactgcgtgtggggcgtgcacgtccaggaagagaagcgcatcttgctccaagttgagatattgaatgtgcgggaaggggacatgctgacgctgttcgacggggacggtcccagcgcccgagtcttggcccagctgcggggacctcagccgcgccgccgccttctctcctctgggcccgacctcacactgcagtttcaggcaccgcccgggcccccaaatccaggcctgggccagggcttcgtattgcacttcaaagaggtcccgaggaacgacacgtgccccgagctgccacctccggagtggggctggagaacggcatcccacggggacctgatccggggcacggtgctcacctaccagtgcgagcctggctacgagctgctaggctccgacattctcacttgccagtgggacctgtcttggagcgccgcgccgcccgcctgccaaaagatcatgacttgtgctgaccctggcgagattgccaacgggcaccgcaccgcctcggacgccggcttccccgttggctcccacgtccagtaccgctgcctgccagggtacagcctcgagggggcagccatgctcacctgctacagccgggacacaggcacacccaagtggagcgatagggtccccaaatgcgccttgaagtacgagccgtgcctgaacccgggggttcccgagaatggctaccagacgctgtacaagcaccactaccaggcgggcgagtctctgcgcttcttctgctatgagggctttgagcttatcggcgaggtcaccatcacctgtgtgcccggccacccctcccagtggaccagccagcccccactctgcaaagttgcctatgaggagctcctggacaaccgaaaactggaagtgacccagaccacagatccatcacggcagctggaaggggggaacctggccctggccatcctgctgcctctaggcttggtcattgtcctcggcagtggcgtttacatctactacaccaagcttcagggaaagtcccttttcggcttctcgggctcccactcctacagccccatcaccgtggagtcggacttcagcaacccgctgtatgaagctggggatacgcgggagtatgaagtttccatctgaaccccaagactacagctgcaggacccaggacgcccctcccctcctcattcgggcagagggaaatacgggacccggtctctgcctcctggctgccctcctccctggctgtgtaaatagtctccctatcccacgagggggctttgatggccctggagatcctacagtaaataaaccagcatcctgccgcccaaagccgcctcttctcagttgccaaacgaggggcctgccccccgccctaccggcttttggattctgggaggggaactctgcctccctgcaaatcttgcagcccctcctgcccagggcacccctcaaggactgcccccgatagctctactgttcccttggccacgaaggtgcccccctcccagatgccctggccctaggcctgactccggccaggagggtcagaagaaggacaaaggggagagctgggacaaggccttgcccccttcctgccatctccccaacccacagtctctccacctttgcttctgaattcttgtttttgagcaataaacagaaaatcgccacttgt

SEQ ID NO: 179592 - DNA, 1191 bp, Homo sapiens
  Payload ID: 15396
  Gene Symbol: SZT2
  Gene Name: seizure threshold 2 homolog (mouse)
  Uniprot ID: Q5T011
  ENST ID: ENST00000372450
  CDS Start-End: 88-624
ggttcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagagacagggtttcaccatgttggccaggctgccctcgaacttctgacctcaagtgatccacctgcctcagcctcccaaagtgctgggattacaggcatgagctactgtgcctggcccaaagcagcatttgaactgagttttgaagaaagaattgaggttaaccattcaaagaaggggaaatggacttttctgacagagggaccagcaaaagcaaatacatggtactatgaacctgtactctcaatcacaggtgttttagggaactacatattattcagtgtcaacagagtaaaatttgaatgtggaaagggatggtaaagaggagactgtagacataagtgggagctggttatgaaaggccatgaatgtgacactaaggactttgtgctttattctatgggggagttcagtgtggaggataagagcactggatctggaatcacattgcctgtgtttgcttcctggcagtaccacttactggttgtgtgtccttgagcaagttacttaacctttctgtgcatctgtgacctttttccaaaggggatattaacattgcttatatcatatggtgattgaattaatacatgtcaagcacttagaactgtgcttgcca

SEQ ID NO: 179593 - DNA, 2133 bp, Homo sapiens
  Payload ID: 15396
  Gene Symbol: SZT2
  Gene Name: seizure threshold 2 homolog (mouse)
  ENST ID: ENST00000406439
  CDS Start-End: 6-512
gtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccagatgatatgatcttttatttggaaaaacctaatggctccaccaaaaaactattagaactgataaacaaattcagtaaagttgcaagatacaaaatcaacatacagaaaatcagtagcatttctgtatgtcagcagcagacaatgtgaagaagaaatcaagaaagtaatcccatttacgatagtttaaaataaaatacctaggaattaaccaaagaagtgaaagatctctacaatgaaaactataaaacatcgatgagagaaattgaagtggactccaaaaattggaatgatattccatgttcatggattggaagaatcagtattgttaaaatgcccacactgcctaaagcagtctacagattcagtacaattcctatcaaaataccaatgacattcttcatagaaatagagaaaacaatcctaaaatttatatggaaccacaaaagacccagaatagccaaagctattctgagcaaaacaaacaaaactggaggaatcacattacctgacttcagattatactacaaagctatagtaaccaaaaacagcatggtactggcataaaaacagacacatagaccaatggaacagaatagagaacccagaagccatatatctacaatgaactcatttttgacagatgccaagaacatacattggggaaagaacagtctcttcaataaatggttctgggaagactggatattcatatgcagaagaatgaaactagactcctatctcacaaaaatcaaatcaaaatggattaaagacttaaatctggccaggcgcagtggctcacacctgtaatcccaacactttgggaggccaaggctggtcttgaactcttgacatcatgatttgcccgcctcagcctcccaaagtgctgggattacaggcgtgagccaccacacccggcgacttcatccactgtctgtccgcttcctgtgtaaggccgaccacccagcccccaaacaacccttaaaatgagacccaaaccaaagacctaacatataagcctcaaatcagtaaacctctcctgaaacaggcagaggaactgcctgcccagaaatactcacaataggctgtgcagattgtaaagagatcaacagcttcacccacgctctgcataaactctggtactggctgtgttctccatagaaggtctcgctgtgttgcctgggctggagtgcagtggtgtgaacacagctcactgcagccttgatctcttgggcttaagtgattctcctgcctcagactcctgagtagctgagaccacaggtgcatttcaccactcagctaatttttagtttttttgtagagatgaggtctctaccaagctggtctctaactcctgggctcaagcgatcttcccatcttggcctcccaaagtgctgggattacacatgtgaaccactatgcttggctcaaagatttattgataataccctgcaagcacaagcgtgcaaagcaaaaatggacaaataggatcacatcaagttaaaaagctgcacagcaaaggaaacaataaacaaagtgaggaaacaaccacagaatgggagaaaatatttgcaaaccacccatctgacaagggattaattaccagaatatataaggagctcaaacaactctat

SEQ ID NO: 179594 - DNA, 12281 bp, Homo sapiens
  Payload ID: 15396
  Gene Symbol: SZT2
  Gene Name: seizure threshold 2 homolog (mouse)
  Uniprot ID: Q5T011
  ENST ID: ENST00000562955
  CDS Start-End: 1-10128
atggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggtgctggtacagggctgcctcttggacccttcccagcgggaggtgttcctgcagcagatatatgagcagctctgcctctttgaggataaggtggccaccatgctgcagcagcagtacgatccccagagccaggcagaagaccagtccccagactcaggggacctactgggccggaaggtaggcgtctccatggtgacagctgatcttgggctggtcagtatgattcgtcagggcatcttggcactgcagttactaccctcgaactctagtgcagggattatcgtgatcacggatggggtgaccagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggctctcagcaccgcctatttaatgagcacctggtctctgcaagcagcaaccctgccctggccttgcgccggaagaagcacactgagaaggaggtgccagccgacttggtcagcactgtgtccgtacggcttcgagagggctacagtgtccgagaggtcacactggccaaaggagggtcccaattggaggtaaagctggtgctgctgtggaaacacaacatgcgcattgagtatgtggctatggcaccctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacaccaatccccaagcacttgcacaccccgggcagcaatgggcgctacagcactatccagtgcaggatctcccactcctccctgacctctctgctgcgggactggagcagcttcgtactagtcgagggctattcttatgttaagctgctctccagtgccccagaccagccccccaattccttctacatggtccgtatcatttccaaggccccatgcatggttcttcgcctgggttttcccattggcacaccagcaccggcccggcacaagattgtgtcaggcttgagggaagagatcctgcggctgcgtttcccccaccgggtacaaagcaaggagccaacgcccaaggtgaaacgaaaagggctagggggtgctggtgggggcagctctccctccaagtcaccccccgtgctggggccacagcaggccctgtctgaccggccctgccttgtggtcctgcataagccactggacaaactgctcatcaggtatgagaagctgcccttggactaccgggcacccttcttgctgacattggagccaccaggtccactgcccttggtgtcaggccgctcagcctcttctagcctggcgtcactgtcccgctacctctaccatcagcgctggctttggagtgtcccgtcaggactggcccctgcgctgcctctcagtgccattgcccagctcctctccatcctcactgaagtccgactttctgaaggattccacttcgcctgcagtggggaaggaatcatcaacatggttctggagcttccaattcagaatgaaccaccagggcaggctgcagctgaagagaagcacacctgtgttgtccagtacatcctcttccccccacactctacctccaccaaagacagcttctcgacagatgatgacaatgatgtggaagtggaggccctggagggagactcagagctcaatctggtcactgaggtgtgggtggagccacagtatgggcgagtgggacctggccctggaatctggaagcacctccaggacctgacgtattctgagatcccgcaagctctccacccacgggatgctgcctgcataggctccatgctgagctttgaatacctgatacagctgtgtcagagcaaggaatggggtcctctgcccccagagccgagggtctctgatggattggatcagggaggagacacctgcgtccatgagatccctttccattttgacctaatgggattgctgccacagtgccagcagctccagatgttcttcctcttgcttgccagaggtgccgaggggccactgctgggggttcatgggatcccgaaggagcaagcagtcggcagcacccaggccacaggagactccgcttttacttccctgagtgtaggtcttcctgaaactctcaagcctctcatctctgcccagccccctcagtggcgctgctatgcaaggcttgtgaacccccagcatgtgtttctgacttttctcccagctaccttctcagatgtccagcgtctggctgcctgtggcctggagggaccccctcaagaggagacaaagcctaagtttggggattggagtggggctcccagtctgaaagatctaggaggaactgggatcaaagctacaaagtcccacgtccctgtcctcagtgtgaccctggctagtgacaatgcccagaatcaaggagagctaagtccaccattccgtcgagacttacaggcttacgctgggcgtcaggcttcccagacagagagtgcggatgggccccggacccggtgtcctgtctacatctacagctgttcactggaagcgctgagggaacaaatggttggcatgcagccccctcaggcgccccgagacctcatcttccggactcagttcctcgaccacccctccccatcctcagcctggatggaaccccggtacaaggaggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctgggccaggtgctttccagtctggagggccccccagttggaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagaatgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctgagggagtggactggaccactgaatgtcactgttccttgaatcatgggcctaccagattgcctgccagaggcaggactgaccagcccttctgggccccagggcaagccagacactgagtgacaccaaaggctttgtaactatgtcttgagggtctgctgccccagcctggcagcaggaaccgccctccccaaacacccacagccactgacccatccaggactccagagagtcaggtcaaccccgaggaccccttgggcccttctggggtactcctttcggcccccctggtagagtctcgggagttcacacagggtggcaaacaccccctagagctcctctgcctgaatcctgccccctagcctttgaccactgtcagccacctgtgtcccttgagccttcgggtcttcacttcccacttggacatcactgctggacattcccatcgagatgacacctgggttccaatcccagctctgcctttgaagcacttgtggccaccgtcaagtccctttgctctcggaccctgggtttctcatcctttaatgaggtgggttcagaagctctcccatcttcacagcaaccctggcactggcttctcaatgggagggaagcagcagagaaactgaagtgttagacactatgtgtcccaccaccccattacagagacatatgacaatgttcagcaggtcatctttaatgcagaggaggagatgggatgtcactcgctgtctggaggcacgtgggtggtgtgcgggccctcactggccagcctctgggtggccccgcctatcccagtatgaacgtagccaactcaagccctctactgtgtctcctgcagggagagggaggcctcggcacctcagcccacaaggagaaaacagcccctgtccgggtccctccagagctcccttccccagggccacgcctcacctcgaggctgatactcacagcccacgaagcctttgtagccttcatcttccagcagttgaaacagataggggaaattcagctctccggggctgctgggctcccctcggcctgggacctgtgccacctgcacatgccctggggacagatgtggacaaatgtggggtccaggctcctgccagggcctgaaggacagatgtggggattgaaagggtgggagggcaaaggaaggtcctctcaccaacaatgggcaggaactcccggatgtttcctgtcaggttcccatccatgatctgccagtggaatatgtcctagggaagaggatactacattccgagaccccgcaggccccgccctccttccgatctgcgaagtacccccttccacttaccatttgtaattggaggttgggtcttcctaccttctgtaagatggctgccgctgtaagagaagccagggaggggaccgtgagcctcaagagcacaggaatcaaaagggacagaaggagagacagggctggggtcgtaccctgctggggcgtgtccaggaagtactgggggtcagtgatgcgggtgttgatgggctccagcagtcccacgaggtcctcctagcagcatgtcgggtgctgtgaatagagctccttcccaagtttgtcccccatcagtcagtcactggtcaaggccctcacctgttcctctgacctaggctggcagcctcacgtgctgtccccactgtgcacccccttctccgcacacccacagagacatgtaagtacgtgtgtgtttccacctttctcacctgagccaaaaccccagctgcatgcctcaggttctccagaaaaacggcctccatctcagccttgactgctattcgatcagctccctggggtactcggccagccatcaggtggatcctgtggggaagatggactggaggccttgcctcccttggctctctctgcacctcttccaggattccctgactgtgccagccctcgtccgtctccccaggtctccagtccatggcacctgggtcacgatgcccaggtatcccagcactttcagagacacttcagtgatggctgaggggcaagccctttcccagacatctcagtgtccacccaccgcctcctgcctccagtactttccaaaacctttccttccctcggtccttctccgcaacctgtaacctgctaaattctcacctttaaaaattgtcctgaccttt

SEQ ID NO: 179595 - DNA, 10299 bp, Homo sapiens
  Payload ID: 15396
  Gene Symbol: SZT2
  Gene Name: seizure threshold 2 homolog (mouse)
  ENST ID: ENST00000634258
  CDS Start-End: 1-10299
atggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaattggaagtcctcagtgtcctgccccctgggtggcagccagatgaaccagtggtcccaaggccattcctcctggtaccttccacccgggtcaccttcctggcttggcagtatcggtttgtcattgagttggaccttagcccatctactggcattgtggatgattccacaggggagatcttgtttgatgaagttttccatgccctgtcccgctgcttaggcgggctgcttcggcccttccgagtgcctggatcttgcatcgacttccagcctgagatctatgtaactatccaggcctactcctccatcattggactgcagtcccaccaggtgctggtacagggctgcctcttggacccttcccagcgggaggtgttcctgcagcagatatatgagcagctctgcctctttgaggataaggtggccaccatgctgcagcagcagtacgatccccagagccaggcagaagaccagtccccagactcaggggacctactgggccggaaggtaggcgtctccatggtgacagctgatcttgggctggtcagtatgattcgtcagggcatcttggcactgcagttactaccctcgaactctagtgcagggattatcgtgatcacggatggggtgaccagtgtacctgatgttgctgtctgtgagacactgctgaaccagcttcgcagtggcactgtggcttgttcctttgtccaggtgggaggagtttactcttatgactgcagttttggccatgtgcccaatgtggaattaatgaagttcatcgcaatggcaacatttgggtcctacctgtccacttgtcctgagccggagccaggcaacctgggtctgactgtctaccaccgggcatttctcctctattccttcctgcgcagtggggaagcactgaaccctgaatattactgcggctctcagcaccgcctatttaatgagcacctggtctctgcaagcagcaaccctgccctggccttgcgccggaagaagcacactgagaaggaggtgccagccgacttggtcagcactgtgtccgtacggcttcgagagggctacagtgtccgagaggtcacactggccaaaggagggtcccaattggaggtaaagctggtgctgctgtggaaacacaacatgcgcattgagtatgtggctatggcaccctggcccctggagcctgagggccctcgagtaacacgggtggaagtgacgatggaaggcggctacgacattttgcatgatgtgtcctgtgcactaaggcagcccattcgttcattgtatcgtacccatgttatccggcgtttctggaacacgctgcagagcatcaaccagacagaccagatgcttgcccaccttcagtccttctcctcagtgcctgagcatttcacgcttcctgacagcaccaagagcggagtgccactcttctacatccctccaggctccaccaccccggtgctctccctccagcccagtggttctgactcatcccatgcccagtttgctgcctactggaagccagtgctgtccatggatgcaaattcctggcagcgatggctgcacatgcatcgcctggtgctaatcctggagcatgacacaccaatccccaagcacttgcacaccccgggcagcaatgggcgctacagcactatccagtgcaggatctcccactcctccctgacctctctgctgcgggactggagcagcttcgtactagtcgagggctattcttatgttaagctgctctccagtgccccagaccagccccccaattccttctacatggtccgtatcatttccaaggccccatgcatggttcttcgcctgggttttcccattggcacaccagcaccggcccggcacaagattgtgtcaggcttgagggaagagatcctgcggctgcgtttcccccaccgggtacaaagcaaggagccaacgcccaaggtgaaacgaaaagggctagggggtgctggtgggggcagctctccctccaagtcaccccccgtgctggggccacagcaggccctgtctgaccggccctgccttgtggtcctgcataagccactggacaaactgctcatcaggtatgagaagctgcccttggactaccgggcacccttcttgctgacattggagccaccaggtccactgcccttggtgtcaggccgctcagcctcttctagcctggcgtcactgtcccgctacctctaccatcagcgctggctttggagtgtcccgtcaggactggcccctgcgctgcctctcagtgccattgcccagctcctctccatcctcactgaagtccgactttctgaaggattccacttcgcctgcagtggggaaggaatcatcaacatggttctggagcttccaattcagaatgaaccaccagggcaggctgcagctgaagagaagcacacctgtgttgtccagtacatcctcttccccccacactctacctccaccaaagacagcttctcgacagatgatgacaatgatgtggaagtggaggccctggagggagactcagagctcaatctggtcactgaggtgtgggtggagccacagtatgggcgagtgggacctggccctggaatctggaagcacctccaggacctgacgtattctgagatcccgcaagctctccacccacgggatgctgcctgcataggctccatgctgagctttgaatacctgatacagctgtgtcagagcaaggaatggggtcctctgcccccagagccgagggtctctgatggattggatcagggaggagacacctgcgtccatgagatccctttccattttgacctaatgggattgctgccacagtgccagcagctccagatgttcttcctcttgcttgccagagagccagagggtgtccctttcgccgaggggtcctgtcctgccaacgacatggtgctgtgcctgctgcacagctgcctggggcaggagctgagtgaccgggagatcccactgacccccgttgaccaggctgccttcttgagtgaggtgctgcggcggacctgccacgttccaggtgccgaggggccactgctgggggttcatgggatcccgaaggagcaagcagtcggcagcacccaggccacaggagactccgcttttacttccctgagtgtaggtcttcctgaaactctcaagcctctcatctctgcccagccccctcagtggcgctgctatgcaaggcttgtgaacccccagcatgtgtttctgacttttctcccagctaccttctcagatgtccagcgtctggctgcctgtggcctggagggaccccctcaagaggagacaaagcctaagtttggggattggagtggggctcccagtctgaaagatctaggaggaactgggatcaaagctacaaagtcccacgtccctgtcctcagtgtgaccctggctagtgacaatgcccagaatcaaggagagctaagtccaccattccgtcgagacttacaggcttacgctgggcgtcaggcttcccagacagagagtgcggatgggccccggacccggtgtcctgtctacatctacagctgttcactggaagcgctgagggaacaaatggttggcatgcagccccctcaggcgccccgagacctcatcttccggactcagttcctcgaccacccctccccatcctcagcctggatggaaccccggtacaaggaggcagctaaccactgtgccctgctgcaggagcatgcacagcggtgctatgtccgtgggctattccgcagcttgcagcaagcacagagtgtgacctcccaggatttgctgacagcggtagatgcctgtgaggagctactacaagaaatagacatcaccccatttctccttgcattgtgtggccacacttggggtttgcctcatgcacccccaagtcctggtcctctcagccctgggcccttcagcagcagcatggaggagggtgctgaacctcgggaacgagctatcctagcttctgaatccagcatagagaccgaggacctaagcgagcctgagtttcagagcacccgtgtccctggcattccagaccctgggccagagatctctctgacagatgtctgccagctcagaggagaggcccatggtgcccttcatagcgtcatccaggagaagttcctagagatcagtcgtctccacttccgcacagtgccttccaatccccactacttcttctattgccctccatccagcaggcgagaagatgaggggcctcgggacacagtagacagaaaaatcagtgacctggagttttcagaggctgagcttatgggagaagaaggagacacatctgcctgctgtgtggtcactgagagtgacccagagctagaggtagaataccgggagagccgtgaatcagacctggggcctgctgggctagactctgcctcgctgtcagacgtagacactgtgaatcctgatgaagactccttcagtatcttggggggcgactcacccactgggcctgagagcttccttcatgacctgccaccgctcttcctgcacctcacgtgctccgtgcggctacgtgggcagcacagctcagtacctgtgtgcagcctgcctacctgcctgggccaggtgctttccagtctggagggccccccagttggaggccgagttcccttgagggacctcagtgtgactctggatgtcttcatgctgactttgcccctggaagtggagctccccacggcctcggaccctcagcaccaccggtcaacatctgaaagcagtgcttcatttccacgatccccagggcagccatcatctttaaggtcagatgatggcctcgggcccccactgccacccccagaagaggagaggcacccaggactatccaatttggccacgccccacagactggctattgagaccaccatgaatgagatccgctggttgttggaagatgagatggtgggggcactccgaagagggggcatcccacagagtcctgccctgcaccgcgcagctgcccatatccatagttctcctggacgctccacctgccttcgccaaactctgccactgagttttgtatttgggccagagcgttccctcacacaattcaaggaggagttccgccgcctccatctccctggccatgttcttcttgaagaccctgacagtggcttcttctttgtggcagctggccaacagccaggtgggtcccatggggagccttcttcagcggcctgggcttggcacagtcatgaggacagggctgaaggcatcgaaggggagaccctgacagccagcccccaagcacctgggtccccagaggattctgagggtgtccccctcatcagcctgccccgcgtgccacagggagggagtcagcctgggcccagccggggattaagtctcatgtccagtcagggcagtgtggactcagaccacctaggttatgatggtggcagcagtggctcagacagtgagggtcccaatgacacccttggtgagaaggcccccttcacattgcggactccacctgggccagcacctccacagccttcactctcaggcctccctgggccctgcctgcctgacttctggctcattgtccgggtcctgcaggaccgtgtggaagtgtatgcacatgcacggagcctgattcgggaggatggggggccgggcactgagtgtcgccacctgcagcagctcctggtgaggcgagttggggagatctgcagggaggtcaaccagcgactgcttcttcaagaccttcatgacagccacgtgtgtaactctcttctggtggccgagagtgaagaagatctgtggcgcagtgagactcccttccactcccgtcagcgggcaccactgcccagtgatgattatgctgctgatgagagctgtgcgccccgtgggtacctggcagccacaatgcagtttgtccctggccatttctcctgtgacgttgtgtggggaactgtgatccgagtccattcacgcctcaaaatggggcccagcatgggggtctctcgggccatccaggccctgcgctctgtgctcaatgccttctctgtggtgaaccggaaaaacatgtttgtttaccaggagcgagcaacaaaggctgtgtactatcttcggctcctagagacatcctgcagtgaccggccatggaaaggggatgcgctgcccccttccctcgctctgtcccgaagccaagagcccatctactctgaggaagcctcgggtcctcgttctcccttagacatggtctctagccgcagttcagatgctgctcgtcctgtgggccaagtggacagacatatccagctgctggtccatggtgttgggcaggcaggtcctgagatcacggatgagctcgtgcgagttctatgtcggcgcctggatgaggccacgctggacgtcatcacagttatgcttgttcggaactgcaagctgacaccagctgatgtggagttcatccagccccctggaagtctcccctcagaggtgctgcatctggccctacccacctcctgcaggccctggcttccagccctggcatggtacctacggcagaacttgctcatcttcctgcactctcccaagtacacagatagcaacagccggaaccacttccaacatccactcccaccacagggtggcctccctgacttggacatctacttgtataacaagcctggtggacagggcactgggggcaaaggggttgcctgcatcactctagcctttgtggatgaaggaggggcccccttgtcactggcgttgtggcccccctcctctccggggcccccagacccactgcgagaggaggaatttgagcaactgacccaggtcatccgctgcccggttgttgtggacagttcttcagctcagaatggggccccacggcttcgattggatgtgtgggaaaaggggaacattagtattgtgcagctggaggagaaactccgaggagcagctcgccaggccctggccgatgccatcatcgagcttcagctgctgccagcttcactatgtacagaggacacacccacaggaagtctcaggaacggatcgttggaaactaagagctctgcaggccgagctagcacctttccccctgcccctgtccctggggagcctgtgactccacccagcaaagcgggccggcgtagcttctgggatatgctgagtaaaacagaatgtggggatttgggttcccccaaaacaactgatgacattgtcctggatcggccagaagacactcggggccggaggcgtcacaaaaccgagagtgttcggactcctggtggagctgagcgggcgccaggctcagattctggagcccagagacaaaagcgccggacaacacagctagaagagggtgaggtggggacccttcatcctgtgtttgcccgtgttgctcagcgctggatggagtttatggttcagattggttgtgcctcagtgtccagaagctctgcccacatggtgtcccggttcctccttccatccatcctgtctgagttcaccgcactggtcacctcaatggctggagacaccagtgtccgcatctttgagcagcatttgggttcagagccagagatcttcggcccttgttcccctgggcaactgggcccctctccccgccctgcagctgagcggcatctgctgcttctgggaaggaacttcttgcagtggaggagaccaacacagcaggctgccaaagccatgcagcgcttcgagccaggaggtgatgggagctcagggcgaaatgctccccggcagaggctcttgctactagaggttgtggacaagaagctacagctgctgacctacaactgggctccagacctgggggcagcattgggccgagcgctggttcgcctggtgcagtggcagaatgcacgagcccatctcatcttctgcctactcagccagaagcttggcctcttccatcattatggccagttggacttccccgtgcgagatgaaaaggagccaaacccattcctgctgccgaccatggaagtggagaccctcatccggagtgcaagtcccccgctgagccgtgagcagggccgactgagtgggtcctctcgtggtgggggtcctcttcccctggacacattcccctttgacgaggccctaagggatatcacggctgcccgccccagctccgtacttggtcctgtgcccagacctcctgatcctgtcacctaccatggacaacagttcctagagatcaagatggcagagcgcagagagctggagcgccagatgaagatggaaaacctgtttgtaacctggcagcagcgttctaccccagccaccatgcccatcagtgctggagagctggagaccctgaagcagtcatcccgcctggtgcattactgtgcaacagccatgctcttcgacccagctgcctggctgcatgggcccccagagacctctggaccccctgacgggcagcggcgccatcgccctgagtcagggtctgggagccgagaggcccccacaagctgtgaatccttggatgtgtcgcccccgggagcccgtgaggagccttggctgaaggagctgagcttggctttcctgcagcaatatgtgcagtatctgcagagcataggttttgtgctggtaccactgcggcccccctcacccgcccgcagcaccagccggccacgggccatggctatccttggaacagagggtcgaggctccttctcctgccctaaaaccaagactgatgggagccccaagagcactagctctccggtaaccacctaccacctgcagcgggcactgcctgggggcatcatcctcatggaactggcattccagggctgttacttctgtgtcaaacagtttgccctggaatgttcccgaatcccaatggggcaggctgtcaactcacagctgtccatgctgttcacagaggagtgtgacaaggtgcgggacctgatgcacgtgcactcgttcagctatgacttccatctgcgcctcgtgcatcagcacgtgctaggtgcccatctggtgctgcggcacggctaccacctcaccacctttctgcgacacttcctggcccaccaccctgacggaccccactttggccgcaatcacatttaccaagggacattggagctccccacaccactcattgctgcccaccagctatacaactacgtggctgatcacgccagctcttaccacatgaagccattgcgaatggcccggccagggggcccagaacacaacgagtatgccctggtgtcggcatggcacagttctggctcctacctggactctgagggacttcgacaccaggatgactttgatgtgtctctgcttgtctgtcactgtgctgcaccctttgaggagcaaggagaggctgagcggcacgttctgcggctacagttcttcgtggtgctcaccagccagcgagagctcttccccaggctcactgctgacatgcgccgcttccggaagccacccagactgccccctgagccagaggctcctgggagttcagctggcagccctggggaggcctcagggcttattctagcgcctggaccggctcctctgttcccaccactggctgcagaggtgggcatggcacgagcacggctggctcagctggtgcggctggctggagggcactgccgtcgggacaccctttggaagcgcctcttcttgctggagccaccggggcctgatcgactgcggctaggggggcgcctggccctggcagagctggaggaactcctagaagcagtccatgccaaatccattggggacatcgacccccagctggactgcttcctatccatgacggtctcctggtaccagagcctgatcaaagttctcctaagccgcttcccccagagctgtcgccatttccaaagcccagacttgggaactcagtacctggttgtgctgaatcagaagttcactgactgctttgtgctagtgtttctggactcccacttaggaaagacgtctctgacagtggttttccgagagcccttcccagtacagccccaggacagcgagagcccccctgcccaactggtctccacctaccaccacctggagtctgtcatcaacacagcctgtttcaccctctggacccgcctcctctga

SEQ ID NO: 179596 - DNA, 7925 bp, Homo sapiens
  Payload ID: 15397
  Gene Symbol: SEL1L
  Gene Name: sel-1 suppressor of lin-12-like (C. elegans)
  Uniprot ID: Q9UBV2
  ENST ID: ENST00000336735
  CDS Start-End: 118-2502
gcggaggaaggagactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttgggttacagatactgggctggcatcggcgtcctccagagttgtgaatctgccctgactcactatcgtcttgttgccaatcatgttgctagtgatatctcgctaacaggaggctcagtagtacagagaatacggctgcctgatgaagtggaaaatccaggaatgaacagtggaatgctagaagaagatttgattcaatattaccagttcctagctgaaaaaggtgatgtacaagcacaggttggtcttggacaactgcacctgcacggagggcgtggagtagaacagaatcatcagagagcatttgactacttcaatttagcagcaaatgctggcaattcacatgccatggcctttttgggaaagatgtattcggaaggaagtgacattgtacctcagagtaatgagacagctctccactactttaagaaagctgctgacatgggcaacccagttggacagagtgggcttggaatggcctacctctatgggagaggagttcaagttaattatgatctagcccttaagtatttccagaaagctgctgaacaaggctgggtggatgggcagctacagcttggttccatgtactataatggcattggagtcaagagagattataaacaggccttgaagtattttaatttagcttctcagggaggccatatcttggctttctataacctagctcagatgcatgccagtggcaccggcgtgatgcgatcatgtcacactgcagtggagttgtttaagaatgtatgtgaacgaggccgttggtctgaaaggcttatgactgcctataacagctataaagatggcgattacaatgctgcagtgatccagtacctcctcctggctgaacagggctatgaagtggcacaaagcaatgcagcctttattcttgatcagagagaagcaagcattgtaggtgagaatgaaacttatcccagagctttgctacattggaacagggccgcctctcaaggctatactgtggctagaattaagctcggagactaccatttctatgggtttggcaccgatgtagattatgaaactgcatttattcattaccgtctggcttctgagcagcaacacagtgcacaagctatgtttaatctgggatatatgcatgagaaaggactgggcattaaacaggatattcaccttgcgaaacgtttttatgacatggcagctgaagccagcccagatgcacaagttccagtcttcctagccctctgcaaattgggcgtcgtctatttcttgcagtacatacgggaaacaaacattcgagatatgttcacccaacttgatatggaccagcttttgggacctgagtgggacctttacctcatgaccatcattgcgctgctgttgggaacagtcatagcttacaggcaaaggcagcaccaagacatgcctgcacccaggcctccagggccacggccagctccaccccagcaggaggggccaccagagcagcagccaccacagtaataggcactgggtccagccttgatcagtgacagcgaaggaagttatctgctgggaacacttgcatttgatttaggaccttggatcagtggtcacctcccagaagaggcacggcacaaggaagcattgaattcctaaagctgcttagaatctgatgcctttattttcagggataagtaactcttacctaaactgagctgaatgtttgtttcagtgccatatggaataacaactttcagtggcttttttttttcttttctggaaacatatgtgagacactcagagtaatgtctactgtatccagctatctttcttggatccttttggtcattatttcagtgtgcataagttcttaatgtcaaccatctttaaggtattgtgcatcgacactaaaaactgatcagtgtaaaaaggaaaacccagttgcaagtttaaacgtgttcgaaagtctgaaaatagaacttgccttttaagttaaaaaaaaaaaaagctatcttgaaaatgttttggaactgcgataactgagaaactcttaccagtccacatgcaattagacatattcagcatatttgttattttaaaagggagggttgggaggtttcttattggtgattgtcacacggtataccatactcctctccttcaaagaatgaaaggccttgttaaggagttttttgtgagctttacttctttggaatggaatatacttatgcaaaaccttgtgaactgactccttgcactaacgcgagtttgccccacctactctgtaatttgcttgtttgttttgaatatacagagccttgatccagaagccagaggatggactaagtgggagaaattagaaaacaaaacgaactctggttggggtactacgatcacagacacagacatacttttcctaaagttgaagcatttgttcccaggatttattttactttgcatttctttttgcacaaagaacacatcaccttcctgaattctttaaatatgaaatatcattgccagggtatggcttacagtgactactattataatactaaaactcagagaatcaaagatggattaaactcagtggttgatgaaagccaaaacctgtttgtactgttctatactattcaggtatctttttatttctgatagttttatattataatagaaagccagccactgcttagctatcatagtcaccattttctcactgttaacattaggaaaatcaaggctactatgcttcaggattgtctggttaaatagtatgggaaaaaaactgaagagtttcacataattacacacgtgaaataattaaagcttaaactgaatttgtatttcattttattgtcagatggtggtgttcaccagcctgtatcttgtctgagactgcattcgtatctgagcaggttttctatgcctactgatgtcagtatgtttatactaaccttcatgcttttttcccagaatccctcatctgccagaaaacttgaaaagtttattgcttgtagagttgtactgctttgatttttgaagttggggtagtagttagaactagatttaactagtctataatgaacatgaaggcttttatatatgaagttgtatacctttttgtgtttagagaattatgggaaacctggtaagcaaaactttcctcccagataattgcttccaaattcgaagagttagtcaccaagagagccatatgtatgaaagcgtatctgtgaaaggtaggaaacttaccccccctaagtgtaatgttgctttaggcaactcttgtaaatagtgagacttgtttggtctcttacatgtagagatttgagtgcagttggtacagtactttggtgtctccaccactgtcccttctccccgcttcaaaataagtgtaatccacggtagcagccacacttcctttagaaggaactgttataatttatttaaaagttgaaaaaccacccaagatgactaccaactttcacttttttcttctgccatccaccctcatttttcctttagcaagatttttatatctaactttccttccctccattgagtacgtgctttgagaaaacatttcttaaaacagtgtgtgccacctaaggctggatgggaaagtgcagtcttgttgttcatataaaaacacacttcttattagtttaccacttgcctttttctattgttaatgttctgaatttccttttcttggcttgtttctacttcattttaccctgggtcacttgctgccagcagtttgtgaatggtgtctttcaaataacttagttcttatggcttcacttaaagactgtctcaaaaatactttgctctcttcttcttttttgttcatgggacatggtacctaagcaaataggagttgggtttggtttttctcctaaaataatgctcaatacttacctaatcaaatggcatccatttgaataaaatgacaataactaaagctagttaatgtcagtgacattaaactaactccaggattcaggagttttaatgttagaatttagatttaacagatagagtgtggcttcatttgtccatggtagcccatctctcctaagaccttttctagtctgtcttcctgccttcgaacttgatgacagtaaaaccctgtttagtattctcttgtgcatttggtttgttggttagccgactgtcttgaaactattcattttgcttctagttttattttacagaggtagcattggtgggtttttttttttttttctgtctctgtgtttgaagtttcagtttctgttttctaggtaaggcttatttttgattagcagtcaatggcaaagaaaaagtaaatcaaagatgacttcttttcaaaatgtattgtttagcacttaactcagatgaatttataaattattaatcttgatactaaggatttgttacttttttgcatattaggttaatttttaccttacatgtgagagtcttaccactaagccattctgtctctgtactgttgggaagttttggaaacccctgccagtgatctggtgatgatctgatgatttatttaaagagccgttgatgcctccaggaaacttaagtattttattaatatatatataggaatttttttttattttgctttgtctttctctcccttcttttatcctcatgttcattcttcaaaccagtgttttggaagtatgcatgcaggcctataaatgaaaaacacaattctttatgtgtatagcatgtgtattaatgtctaactacatacgcaaaaacttcctttacagaggttcggactaacatttcacatgcacatttcaaaacaagatgtgtcatgaaaacagcccctttacctgccaagacaagcagggctatatttcagtgacagctgatatttgttttgaaagtgaatctcataatatatatatgtattacacattattatgactagaagtatgtaagaaatgatcagaacaaaagaaaatttctattttcatgcaaatatttttcatcagtcatcactctcaaatataaattaaaatataacactcctgaatgcctgaggcacgatctggattttaaatgtgtggtattcattgaaaagaagctctccacccacttggtatttcaagaaaatttaaaacgatcccaaggaaagatgatttgtatgttaaagtgactgcacaagtaaaagtccaatgttgtgtgcatgaaaaggattccttggttatgtgcagggaatcatctcacatgctgtttttcctatttggtttgagaaacaggctgacactattctctttgattagaaaataaactcataaaactcataatgttgatataatcaagatgtaaccactataaatatgtagaagaggaagttttaaaagaccttaagctggcattgtgaaggaacaccatggtagactctttttgtaaatgtattttgtatttaatgaaatgcagtataaaggttggtgaagtgtaatataattgtgtaaacaaatcctgttaatagagagatgtacagaatcgttttgtactgtatcttgaaacttgtgaaataaagattccacctctggttatcctgtatgctgtaatataccacaaccaagcacctttccagacagactttttttaagctgaatgattcaattttttaatgttttttggaaattcagaagcttctgaaaacattcacttgtggcaatttgaatttatctttcattttaaactcctgaaattcagatttttacaagtccaatattgccctagggagaacatgaatttgctaagaaatgttatcttttaaatctctgatatctttgtcttgaagcagccttgatatgtagtaagcgtgattcactttagcctgattataatattatttatctaaagtttgtttatgcattgccttgtcccaggaattttttaagaggacttgcagagacacgtaccacacagtaacatttagactaaatatgctctgagtaaaggagaaatgaaaaaatattaaatcaagagtgaacatgtacacaaagtgcaattggaagtgggctacaaatttggcccccagcttcccagcaggcaactcaaagaggtaactgaggtaaaatgttccagctcagaagcattggatcttggataaaaagcctacatgatgcaaactgtggcaactgagatgtcagatctcaagatctcaaattgtacttgtgggagcacagtcagtgaccccagatgaccttgactgacctaaaagttgtgggggaagtcggatgtcagagccttaacaccagcaggtgaccatccaacctggggcaatgcctgcctgttcaccacttagcctctttctggcaagtcattagaatgtcctccatcttcattggctgcaacttgatgagctacagcctctttcctaacttcctttatgatgctagtttaggttggttataccagcttggaagtatgcttagattaagttacagcagatacacaaattagatgcaagtaaaaaaaatcagaatttctgtagtagaaactacgaaaaataaaaaggaaagtttttactttttgggtatttttttacgaataagaaaaagtgagcgttaatcagttcaaaaggaggtactgctgtgtaatgggctttgtacgttccttctcatgtcacttacgtcactacttcgccatcaaattgaacaagcttttaattagatcctgaaaattcactatgctagtagtttattggtagtattatattttgagtagaactctgattttccctagaggccaaattctttttatctgggttaatttcttttaaacataacaatgttaatgctgaattgtatattaaatcccatttctaaaaaccacacaattttttctcatgtaagttgagtggaatgtggttagttaactgaatttggaatgttcatataaataatttgttgctgctc

SEQ ID NO: 179597 - DNA, 1631 bp, Homo sapiens
  Payload ID: 15397
  Gene Symbol: SEL1L
  Gene Name: sel-1 suppressor of lin-12-like (C. elegans)
  Uniprot ID: Q9UBV2
  ENST ID: ENST00000555824
  CDS Start-End: 90-995
gcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagctttgaccgccattgaaggcacagcacatggggagccctgccacttcccttttcttttcctagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaaatgatgtatcaaactggaatgaaaatccttaatggaagcaataagaaaagccaaaaaagagaagcatatcggtatctccaaaaggcagcaagcatgaaccataccaaagccctggagagagtgtcatatgctcttttatttggtgattacttgccacagaatatccaggcagcgagagagatgtttgagaagctgactgaggaaggctctcccaagggacagactgctcttggctttctgtatgcctctggacttggtgttaattcaagtcaggcaaaggctcttgtatattatacatttggagctcttgggggcaatctaatagcccacatggttttggtaagtagactttagtggaaggctaataatattaacatcagaagaatttgtggtttatagcggccacaactttttcagctttcatgatccagatttgcttgtattaagaccaaatattcagttgaacttccttcaaattcttgttaatggatataacacatggaatctacatgtaaatgaaagttggtggagtccacaatttttctttaaaatgattagtttggctgattgcccctaaaaagagagatctgataaatggctctttttaaattttctctgagttggaattgtcagaatcattttttacattagattatcataattttaaaaatttttctttagtttttcaaaattttgtaaatggtggctatagaaaaacaacatgaaatattatacaatattttgcaacaatgccctaagaattgttaaaattcatggagttatttgtgcagaatgactccagagagctctactttctgttttttacttttcatgattggctgtcttcccatttattctggtcatttattgctagtgacactgtgcctgcttccagtagtctcattttccctattttgctaatttgttactttttctttgctaatttggaagattaactcatttttaataaaattatgtctaagattaaaa

SEQ ID NO: 179598 - DNA, 594 bp, Homo sapiens
  Payload ID: 15397
  Gene Symbol: SEL1L
  Gene Name: sel-1 suppressor of lin-12-like (C. elegans)
  ENST ID: ENST00000557372
  CDS Start-End: 106-594
gactagagcaggaagagcagcggcgaggcggcggtggtggctgagtccgtggtggcagaggcgaaggcgacagctctaggggttggcaccggccccgagaggaggatgcgggtccggatagggctgacgctgctgctgtgtgcggtgctgctgagcttggcctcggcgtcctcggatgaagaaggcagccaggatgaatccttagattccaagactactttgacatcagatgagtcagtaaaggaccatactactgcaggcagagtagttgctggtcaaatatttcttgattcagaagaatctgaattagaatcctctattcaagaagaggaagacagcctcaagagccaagagggggaaagtgtcacagaagatatcagctttctagagtctccaaatccagaaaacaaggactatgaagagccaaagaaagtacggaaaccagataaggagtatgatgaatgtacatcagatgggagggaagatggcagactgtggtgtgctacaacctatgactacaaagcagatgaaaagtggggcttttgtgaaactgaagaagaggctgctaagagacggcagatgcaggaagcagaa

SEQ ID NO: 179599 - DNA, 2224 bp, Homo sapiens
  Payload ID: 15398
  Gene Symbol: SEL1L2
  Gene Name: sel-1 suppressor of lin-12-like 2 (C. elegans)
  Uniprot ID: Q5TEA6
  ENST ID: ENST00000284951
  CDS Start-End: 76-2142
ctgagaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaa

SEQ ID NO: 179600 - DNA, 1892 bp, Homo sapiens
  Payload ID: 15398
  Gene Symbol: SEL1L2
  Gene Name: sel-1 suppressor of lin-12-like 2 (C. elegans)
  Uniprot ID: Q5TEA6
  ENST ID: ENST00000378072
  CDS Start-End: 83-1810
acagtccctgagaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagaaaaggctaacattcttgaaaaagagaagatgtatccaatggcgcttctcctatggaatcgagctgccattcaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaa

SEQ ID NO: 179601 - DNA, 2348 bp, Homo sapiens
  Payload ID: 15398
  Gene Symbol: SEL1L2
  Gene Name: sel-1 suppressor of lin-12-like 2 (C. elegans)
  ENST ID: ENST00000423870
  CDS Start-End: 79-615
tccctgagaagaggagctcttgggccaatcacctagtttctgcctgtgttacagtgaagagaagctgcttaagagaagatgaagcccttgtctctgttaatagagatattgataattcttggggtcacaattaaaactatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagagattctaatgcctacctggatgtttctctgtctgaggtccttcttgcctggactactctgctccagcttctgcccaagagcagcttattttagcctcagcatggatgggctgtacataaagagcctacctactttttgccaaagcagctgacatgggaaacttgaaagctatggagaaaatggctgacgctttgctatttggaaattttggcgtgcaaaatataacagcagctatccaattatatgagtccttggctaaagaaggatcatgtaaagcccaaaacgcattaggatttttgtcttcttatggaataggaatggaatatgatcaagctaaggcactgatatattacacctttggaagtgctggaggaaacatgatgtcccagatgattttggggtacagatatttgtcgggaatcaatgttctacagaattgtgaagttgccctaagttattacaagaaagtggcagattatattgctgacacatttgaaaaaagtgaaggtgttccagtggaaaaagtgagactaacggaaagacctgaaaatctgagttctaacagtgagattttggattgggacatataccaatactataaatttttggcagaaagaggagatgttcagatacaagtctctcttggacaattacatctaattggcaggaaaggtctagatcaggattactacaaagcattacactacttcttaaaggcagcaaaggccgggagtgcaaatgccatggcatttataggaaagatgtatttagaggggaatgctgccgtgccgcaaaataacgctactgccttcaagtacttttccatggcagccagtaagggcaatgcaatcggccttcatgggcttggtcttctttactttcatggaaaaggagttcccctgaattatgccgaagcacttaaatactttcagaaagctgcggaaaaagggtggcccgacgcacagttccagttaggcttcatgtactactctggctctggaatatggaaggattataaacttgccttcaaatatttttacctggcatctcagagtgggcagccccttgccatttattatctggccaagatgtatgcaacaggaacaggagtagtaagatcatgcagaactgctgtggagctttataaaggtgtctgtgaactaggccactgggctgagaaattcctgacagcttactttgcctataaggatggtgatatagattcttctcttgttcagtatgcactgcttgcagaaatggggtatgaagtagctcaaagcaattcagcattcattttggaatctaaaaaggctaacattcttgaaaaagagaagatgtatccaatggcgcttctcctatggaatcgagctgccattcaaggcaatgcatttgctagagtaaaaattggagattaccattactatggctatgggactaagaaagactatcaaacagcagccacacactacagcattgcagccaacaaataccacaacgcgcaagccatgttcaatctggcttatatgtatgaacacggcttaggcatcacaaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaa

SEQ ID NO: 179602 - DNA, 543 bp, Homo sapiens
  Payload ID: 15398
  Gene Symbol: SEL1L2
  Gene Name: sel-1 suppressor of lin-12-like 2 (C. elegans)
  ENST ID: ENST00000475649
  CDS Start-End: 1-134
atgggcttggtcttctttactttcatggaaaaggagttcccctgaattatgccgaagcacttaaatactttcagaaagctgcggaaaaagggtggcccgacgcacagttccagttaggcttcatgtactactaaaaggctaacattcttgaaaaagagaagatgtatccaatggcgcttctcctatggaatcgagctgccattcaaggacattcacttggccagaagattgtacgacatggctgctcaaacgagtccagatgcccacatacctgtgctctttgccgtcatgaaactggaaactacgcatttgctccgggatatcctgttttttaatttcacaacgagatggaactggctgaaactggacaacaccattggaccacactgggacttatttgtgattggcctcattgttcctgggctgattttgttgcttagaaatcaccatgggtaggatgcggatcacaggaaaacctgctcacgggaatcagttcactccaaggtatccccactaaataaacagtttcccatccaaatcaag

SEQ ID NO: 179603 - DNA, 535 bp, Homo sapiens
  Payload ID: 15398
  Gene Symbol: SEL1L2
  Gene Name: sel-1 suppressor of lin-12-like 2 (C. elegans)
  ENST ID: ENST00000473203
  CDS Start-End: 403-535
ctctgaaggcacttatcctcacggacaacacgctcgttttagggctcccctagagttccaggtttcaaaagtcacgctgcggcagcgaaggaaggaaacctagacaaggggtaaacacccgatgctatcaaagcagaggaacataataaaagacaaaaggaaagaaatgtcaccacacaggtatcagtgaacgaaatcaaacaatatttatcacacatattggaacaaagaacatctagtaatgtaatcaataaaagagaaaatctcctggagaaaaagaagaatcaacgtaaaataagaataaaaggaattcaaaataaagatatcttgaagagaaataagaatcatttacaaaagcaagcagagaaaaattttacagatgaaggagaccagctatttaagatgggcatcaaggttctccagcagtctaaaagccaaaaacaaaaagaagaagcctacctactttttgccaaagcagctgacatgggaaacttgaaagctatggagaaaatggctgacgctttgctatttggaa

SEQ ID NO: 179604 - DNA, 4369 bp, Homo sapiens
  Payload ID: 15399
  Gene Symbol: SEL1L3
  Gene Name: sel-1 suppressor of lin-12-like 3 (C. elegans)
  Uniprot ID: Q68CR1
  ENST ID: ENST00000264868
  CDS Start-End: 84-3377
tcaaaatccatcctgaaggcctgggagccgggcagctgcgcggcacaactccagggggcacactcgccctgcgccctgcgggaatggcgccccggccaaaaaagcaaccagacaaaaacccattgcacgggcgggaactgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattga

SEQ ID NO: 179605 - DNA, 4520 bp, Homo sapiens
  Payload ID: 15399
  Gene Symbol: SEL1L3
  Gene Name: sel-1 suppressor of lin-12-like 3 (C. elegans)
  Uniprot ID: Q68CR1
  ENST ID: ENST00000399878
  CDS Start-End: 124-3522
cggcaggtggccccgcgcgcggcggccggcccggccgggggcgggcgggaaggtggcgcctcgggcgggggccggtccctgcaccaggtgacctgttccggcccggatccgggcggcctcgccatgcagcggcgcggcgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctgaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgactacca

SEQ ID NO: 179606 - DNA, 558 bp, Homo sapiens
  Payload ID: 15399
  Gene Symbol: SEL1L3
  Gene Name: sel-1 suppressor of lin-12-like 3 (C. elegans)
  ENST ID: ENST00000514872
  CDS Start-End: 452-558
aaagagcgcagtggtggcggtggcggcggcaccacacaaaaccctcgggaaacatccagaacgtgccgcgaaccagccggcagggtggggcgcagcccggctgcaaacatgccagcaaggaggcagtcccaaccccgcaggtggacaggtggagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaa

SEQ ID NO: 179607 - DNA, 605 bp, Homo sapiens
  Payload ID: 15399
  Gene Symbol: SEL1L3
  Gene Name: sel-1 suppressor of lin-12-like 3 (C. elegans)
  ENST ID: ENST00000513691
  CDS Start-End: 420-605
ggtggcggcggcaccacacaaaaccctcgggaaacatccagaacgtgccgcgaaccagccggcagggtggggcgcagcccggctgcaaacatgccagcaaggaggcagtcccaaccccgcagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttc

SEQ ID NO: 179608 - DNA, 1326 bp, Homo sapiens
  Payload ID: 15399
  Gene Symbol: SEL1L3
  Gene Name: sel-1 suppressor of lin-12-like 3 (C. elegans)
  ENST ID: ENST00000510448
  CDS Start-End: 1-392
tgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagaattctgcctctgtgtgcctgaaaacacagcgccaaagctcctggcagcatgaagtcttccctttcatttcagtcaagcaatcagatgtgtaagaggataaacaaacactcgtaatgaataaaaatcctcggccacacggactcagagggagggactgagcaggaatcgtaaagtgggcatttagctgagcatggtttccactaatcattgttatttttctgagccagtatagaatagttaaggacaagggagccctgcttgcttctgtttgggcttagagtccaggcttggctactcattagctgtatgactcatggcaagttatttaaccttcctgatccccaaatttctcatcaatacaatgaggttatgagagtagctacttcctaggaacataaaatgaaaaaaatattaagtgaaaaaaaatgcacgtaagatacttaccaaaatgacggctgtagttaaacgttagctgttatatttatctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaa

SEQ ID NO: 179609 - DNA, 553 bp, Homo sapiens
  Payload ID: 15399
  Gene Symbol: SEL1L3
  Gene Name: sel-1 suppressor of lin-12-like 3 (C. elegans)
  ENST ID: ENST00000510880
  CDS Start-End: 329-553
ttgcaaaggacacaaaaggccgacttaaaagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttat

SEQ ID NO: 179610 - DNA, 404 bp, Homo sapiens
  Payload ID: 15399
  Gene Symbol: SEL1L3
  Gene Name: sel-1 suppressor of lin-12-like 3 (C. elegans)
  ENST ID: ENST00000514321
  CDS Start-End: 1-234
actttagctggtgaatatttccataaggctgcgcaaggtggacacatggaagggaccttgtggtgttctctctactatatcacaggcaacctggagacattccctagagatcctgagaaagctgttgtaaaaagtttgtcgacctctgttttaggccaccctcacactgataccctggctctccaaaagattgttcttcataacacatttgggttcaaattcaacctgacctgaccttggtgataaacttgacttagactgacttgaagttttttatcattgttatttagtatatttgacatgaatattcatgttttgtggattttctgttatcctcttgttaatgatttctagcttaatttcactgtgatcagagaatatattctgaatgattccaatccttt

SEQ ID NO: 179611 - DNA, 3500 bp, Homo sapiens
  Payload ID: 15399
  Gene Symbol: SEL1L3
  Gene Name: sel-1 suppressor of lin-12-like 3 (C. elegans)
  Uniprot ID: Q68CR1
  ENST ID: ENST00000502949
  CDS Start-End: 402-3341
cacactcgccctgcgccctgcgggaatggcgccccggccaaaaaagcaaccagacaaaaacccattgcacgggcgggaactggtctgtgcgacccgcaaaagggaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatgatgtggttgccctgcttggctttccttatgcctccagtggagaaaacacaggcattgtcaagaagttcccgaggtttcggaaccgagagctggaggccactcgacgccagaggatggattacccagtgtttactgtttcattgtggctttatttactccattattgcaaggccaacctctgtgggattctgtactttgttgactctaatgagatgtacggcacaccttctgtatttcttacggaagagggctatttgcatattcagatgcatcttgtcaaaggggaagaccttgctgtaaaaactaaattcatcatacctttgaaggagtggtttcgactggatatctcttttaacggaggccagatagtagtaaccactagcattggacaggatttgaaaagctaccacaatcagaccattagcttccgggaggatttccattataatgacacagctgggtacttcattattggagggagcaggtatgtggctggcattgaagggttttttggacccctgaagtactatcgccttcgcagtctgcaccccgcccagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgccacctccacaactcctacctggacctccagcgcaggtatgggagaccctcgatgtgcagagccttcccctgggagaaggagctgaaagacaaacaccccagcttgttccaggcattgctggagatggatctgctgaccgtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggcatatgttgaaacaattagactaaaagatgatgaaatactcaaggtacaaaccaaagaagatggagatgtctttatgtggttgaagcatgaagctacccgaggcaatgcagcagctcagcaacgattggcccagatgctgttctgggggcagcaaggtgtggccaagaatcccgaagcagcaattgagtggtacgccaagggcgccctggagacggaggatcctgcgttaatctatgactatgccattgtgctattcaagggtcaaggagtaaaaaagaacagacggcttgccttagagctgatgaagaaagcagcttccaagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaaactttagctggtgaatatttccataaggctgcgcaaggtggacacatggaagggaccttgtggtgttctctctactatatcacaggcaacctggagacattccctagagatcctgagaaagctgttgtatgggcaaaacatgtagctgagaaaaatggctacttgggccatgtcatccgcaaaggcctcaatgcctacctggaaggttcatggcatgaagctttgctgtattatgttttagcagcagaaactggaattgaagtgtcacagacaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaaggtgctggagccacagtaacgaggagtccttcagcccctgctccttggcctggctttacctgcacttgcggcttctctggggtgctatcctgcactcagccctgatctactttctgggaacctttctgctatccatattgatcgcctggactgtgcagtatttccagtctgtctcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaa

SEQ ID NO: 179612 - DNA, 429 bp, Homo sapiens
  Payload ID: 15399
  Gene Symbol: SEL1L3
  Gene Name: sel-1 suppressor of lin-12-like 3 (C. elegans)
  ENST ID: ENST00000507618
  CDS Start-End: 1-393
acaaatttagcacacatctgtgaggagaggccagacctggccaggagatacttgggtgttaactgtgtttggagatactataatttctctgtttttcaaatcgatgctccttcctttgcatatttgaagatgggagacctttactactatggccaccaaaaccagtcacaagacctggagttgtctgtgcagatgtacgcccaagccgccctggatggagactcccagggattttttaacctggccctgctaatcgaggaaggtacgataatcccacaccatatcttggatttcttggaaattgactcaactctccattctaataacatctccattctccaggaactgtacgaaagatctactttctgggaacctttctgctatccatattgatcgcctggactgtgcagtatttccagtctgtctcag

SEQ ID NO: 179613 - DNA, 3857 bp, Homo sapiens
  Payload ID: 15400
  Gene Symbol: SELE
  Gene Name: selectin E
  Uniprot ID: P16581
  ENST ID: ENST00000333360
  CDS Start-End: 141-1973
ttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 179614 - DNA, 1518 bp, Homo sapiens
  Payload ID: 15400
  Gene Symbol: SELE
  Gene Name: selectin E
  ENST ID: ENST00000367774
  CDS Start-End: 49-1503
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcag

SEQ ID NO: 179615 - DNA, 3389 bp, Homo sapiens
  Payload ID: 15400
  Gene Symbol: SELE
  Gene Name: selectin E
  ENST ID: ENST00000367775
  CDS Start-End: 48-1505
aaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaatggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 179616 - DNA, 3576 bp, Homo sapiens
  Payload ID: 15400
  Gene Symbol: SELE
  Gene Name: selectin E
  ENST ID: ENST00000367776
  CDS Start-End: 49-1692
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctgtgagatgcgatgctgtccaccagcccccgaagggtttggtgaggtgtgctcattcccctattggagaattcacctacaagtcctcttgtgccttcagctgtgaggagggatttgaattacatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 179617 - DNA, 3576 bp, Homo sapiens
  Payload ID: 15400
  Gene Symbol: SELE
  Gene Name: selectin E
  ENST ID: ENST00000367777
  CDS Start-End: 49-1692
gaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagatggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatatgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaagtttcagagaagttctggctgaacactggcaacaacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgttt

SEQ ID NO: 179618 - DNA, 560 bp, Homo sapiens
  Payload ID: 15400
  Gene Symbol: SELE
  Gene Name: selectin E
  ENST ID: ENST00000609271
  CDS Start-End: 525-560
acatccgggaactcagagtgttaaaacttgagctcattattttcccctagacaccaattattccttttttattttccgtctttattaacgaaagtgtttactgcctaagccagacactgagagccaccatgtattcctctctctctctcacctattcccatgtttaatccattatttggattggtccattttatctccattttctcaaatacaggaaaagacagatcatcatcaaccagcaattgtgactatctacatattcacataaggatttcccaacttggggtatttttgtcaagttgagaccaggcatcttggagttagaagcaatccctcctataaaagggcctcagccgaagtagtgttcagctgttcttggctgacttcacatcaaaactcctatactgacctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttg

SEQ ID NO: 179619 - DNA, 2436 bp, Homo sapiens
  Payload ID: 15401
  Gene Symbol: SELL
  Gene Name: selectin L
  Uniprot ID: P14151
  ENST ID: ENST00000236147
  CDS Start-End: 162-1319
ggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 179620 - DNA, 3142 bp, Homo sapiens
  Payload ID: 15402
  Gene Symbol: SELP
  Gene Name: selectin P (granule membrane protein 140kDa, antigen CD62)
  Uniprot ID: P16109
  ENST ID: ENST00000263686
  CDS Start-End: 39-2531
tgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttcccc

SEQ ID NO: 179621 - DNA, 2402 bp, Homo sapiens
  Payload ID: 15402
  Gene Symbol: SELP
  Gene Name: selectin P (granule membrane protein 140kDa, antigen CD62)
  ENST ID: ENST00000367786
  CDS Start-End: 3-2309
agatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaaggaaatgataattatttaaatttctttggtctcatttccagagacctgtccttttcctggtctcctcattcagcctccatatgatcctgttgt

SEQ ID NO: 179622 - DNA, 2427 bp, Homo sapiens
  Payload ID: 15402
  Gene Symbol: SELP
  Gene Name: selectin P (granule membrane protein 140kDa, antigen CD62)
  ENST ID: ENST00000367788
  CDS Start-End: 120-2426
tttctggaatgtgaataggaagttgtttttctaaacagcctgacactgaggggaggcagtgagactgtaagcagtctgggttgggcagaaggcagaaaaccagcagagtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaag

SEQ ID NO: 179623 - DNA, 1345 bp, Homo sapiens
  Payload ID: 15402
  Gene Symbol: SELP
  Gene Name: selectin P (granule membrane protein 140kDa, antigen CD62)
  ENST ID: ENST00000367795
  CDS Start-End: 13-1345
gtcacagaggagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaag

SEQ ID NO: 179624 - DNA, 3088 bp, Homo sapiens
  Payload ID: 15402
  Gene Symbol: SELP
  Gene Name: selectin P (granule membrane protein 140kDa, antigen CD62)
  ENST ID: ENST00000426706
  CDS Start-End: 1-2370
gccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctgtgcagtgtcagcacctggaagcccccagtgaaggaaccatggactgtgttcatccgctcactgcttttgcctatggctccagctgtaaatttgagtgccagcccggctacagagtgaggggcttggacatgctccgctgcattgactctggacactggtctgcacccttgccaacctgtgaggctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaagccattccctgcacacctttgctaagccctcagaatggaacaatgacctgtgttcaacctcttggaagttccagttataaatccacatgtcaattcatctgtgacgagggatattctttgtctggaccagaaagattggattgtactcgatcgggacgctggacagactccccaccaatgtgtgaagccatcaagtgcccagaactctttgccccagagcagggcagcctggattgttctgacactcgtggagaattcaatgttggctccacctgccatttctcttgtgacaacggctttaagctggaggggcccaataatgtggaatgcacaacttctggaagatggtcagctactccaccaacctgcaaaggcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagatgatgggaaatgccccttgaatcctcacagccacctaggaacatatggagtttttacaaacgctgcatttgacccgagtccttaagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccaggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaagaccaatattcaaatgcgtaattaaaagaattttccccaaa

SEQ ID NO: 179625 - DNA, 1945 bp, Homo sapiens
  Payload ID: 15402
  Gene Symbol: SELP
  Gene Name: selectin P (granule membrane protein 140kDa, antigen CD62)
  ENST ID: ENST00000458599
  CDS Start-End: 4-1944
gagatggccaactgccaaatagccatcttgtaccagagattccagagagtggtctttggaatttcccaactcctttgcttcagtgccctgatctctgaactaacaaaccagaaagaagtggcagcatggacttatcattacagcacaaaagcatactcatggaatatttcccgtaaatactgccagaatcgctacacagacttagtggccatccagaataaaaatgaaattgattacctcaataaggtcctaccctactacagctcctactactggattgggatccgaaagaacaataagacatggacatgggtgggaaccaaaaaggctctcaccaacgaggctgagaactgggctgataatgaacctaacaacaaaaggaacaacgaggactgcgtggagatatacatcaagagtccgtcagcccctggcaagtggaatgatgagcactgcttgaagaaaaagcacgcattgtgttacacagcctcctgccaggacatgtcctgcagcaaacaaggagagtgcctcgagaccatcgggaactacacctgctcctgttaccctggattctatgggccagaatgtgaatacgtgagagagtgtggagaacttgagctccctcaacacgtgctcatgaactgcagccaccctctgggaaacttctcttttaactcgcagtgcagcttccactgcactgacgggtaccaagtaaatgggcccagcaagctggaatgcttggcttctggaatctggacaaataagcctccacagtgtttagctgcccagtgcccacccctgaagattcctgaacgaggaaacatgacctgccttcattctgcaaaagcattccagcatcagtctagctgcagcttcagttgtgaagagggatttgcattagttggaccggaagtggtgcaatgcacagcctcgggggtatggacagccccagccccagtgtgtaaagctatttcgtgtgagccgctggagagtcctgtccacggaagcatggattgctctccatccttgagagcgtttcagtatgacaccaactgtagcttccgctgtgctgaaggtttcatgctgagaggagccgatatagttcggtgtgataacttgggacagtggacagcaccagccccagtctgtcaagctttgcagtgccaggatctcccagttccaaatgaggcccgggtgaactgctcccaccccttcggtgcctttaggtaccagtcagtctgcagcttcacctgcaatgaaggcttgctcctggtgggagcaagtgtgctacagtgcttggctactggaaactggaattctgttcctccagaatgccaaggtaagagcatagcatcacttcctactccaggggtgcaatgtccagccctcaccactcctgggcagggaaccatgtactgtaggcatcatccgggaacctttggttttaataccacttgttactttggctgcaacgctggattcacactcataggagacagcactctcagctgcagaccttcaggacaatggacagcagtaactccagcatgcagagctgtgaaatgctcagaactacatgttaataagccaatagcgatgaactgctccaacctctggggaaacttcagttatggatcaatctgctctttccattgtctagagggccagttacttaatggctctgcacaaacagcatgccaagagaatggccactggtcaactaccgtgccaacctgccaagcaggaccattgactatccaggaagccctgacttactttggtggagcggtggcttctacgataggtctgataatgggtgggacgctcctggctttgctaagaaagcgtttcagacaaaaagatgatgggaaatgccccttgaatcctcacagccacctaggaacatatggagtttttacaaacgctgcatttgacccgagtccttaag

SEQ ID NO: 179626 - DNA, 1704 bp, Homo sapiens
  Payload ID: 15403
  Gene Symbol: SELPLG
  Gene Name: selectin P ligand
  Uniprot ID: Q14242
  ENST ID: ENST00000228463
  CDS Start-End: 178-1464
aatcatccgagaaccttggagggtggacagtgccccttttacagatgagaaaactgaggcttgaaggggagaagcagctgcctctggcggcatggcttctggctgcaggatgcccatggagttcgtggtgaccctaggcctgtgtctcggcttcctttgctgaacttgaacaggaagatggcagtgggggccagtggtctagaaggagataagatggctggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccg

SEQ ID NO: 179627 - DNA, 1613 bp, Homo sapiens
  Payload ID: 15403
  Gene Symbol: SELPLG
  Gene Name: selectin P ligand
  ENST ID: ENST00000388962
  CDS Start-End: 24-1232
cccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaagg

SEQ ID NO: 179628 - DNA, 2256 bp, Homo sapiens
  Payload ID: 15403
  Gene Symbol: SELPLG
  Gene Name: selectin P ligand
  Uniprot ID: Q14242
  ENST ID: ENST00000550948
  CDS Start-End: 226-1464
aaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccattccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaa

SEQ ID NO: 179629 - DNA, 1752 bp, Homo sapiens
  Payload ID: 15404
  Gene Symbol: SELENBP1
  Gene Name: selenium binding protein 1
  Uniprot ID: Q13228
  ENST ID: ENST00000368868
  CDS Start-End: 93-1511
ataaattccctcccttcgctccttccccggaacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttcaga

SEQ ID NO: 179630 - DNA, 788 bp, Homo sapiens
  Payload ID: 15404
  Gene Symbol: SELENBP1
  Gene Name: selenium binding protein 1
  ENST ID: ENST00000455839
  CDS Start-End: 65-208
ggaacagcggcctctgacaccagcacagcaaacccgccgggatcaaagtgtaccagtcggcagcatggctacgaaatgtgggaattgtggacccggctactccacccctctggaggccatgaaaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagagacagagtttcaccatgttggccaggctgatcctgaactcctgacctcaagtgatccgcccgcctcagcctctcaaagggctgggattactggcatgagccactcttcccccagccctggatgcctgaatttaaggaactggcaaatccagcagtggagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggag

SEQ ID NO: 179631 - DNA, 1521 bp, Homo sapiens
  Payload ID: 15404
  Gene Symbol: SELENBP1
  Gene Name: selenium binding protein 1
  ENST ID: ENST00000455397
  CDS Start-End: 51-422
tgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggcatgtcattgagcccaaggacatccatgccaagtgcgaactggcctttctccacaccagccactgcctggccagcggggaagtgatgatcagctccctgggagacgtcaagggcaatggcaaaggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccct

SEQ ID NO: 179632 - DNA, 916 bp, Homo sapiens
  Payload ID: 15404
  Gene Symbol: SELENBP1
  Gene Name: selenium binding protein 1
  ENST ID: ENST00000424475
  CDS Start-End: 1-916
ctgcagaacgtgcggagggagccttcaccctccagagcgtggcccagccaatgcgccccattgcttccacagctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcct

SEQ ID NO: 179633 - DNA, 1928 bp, Homo sapiens
  Payload ID: 15404
  Gene Symbol: SELENBP1
  Gene Name: selenium binding protein 1
  Uniprot ID: Q13228
  ENST ID: ENST00000426705
  CDS Start-End: 146-1690
aacagcggcctctgacaccagcacagcaaacccgccgggatcaaagtgtaccagtcggcagcatgggtcatgtgtctccagctcttcccagcacaacctcaccctcctcagggctctgagggggcggagaggacaggccagagcgatgaggctggagtggggacctaggccagccgcactgccgtggcccgctgggatgtgtgctgcagaacgtgcggagggagccttcaccctccagagcgtggcccagccaatgcgccccattgcttccacagctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttc

SEQ ID NO: 179634 - DNA, 377 bp, Homo sapiens
  Payload ID: 15404
  Gene Symbol: SELENBP1
  Gene Name: selenium binding protein 1
  ENST ID: ENST00000427867
  CDS Start-End: 136-377
ctcctcaagaacagccaagggtgcctgggcttcgaccagacaaacacagagctgcacacctactgcaccctcgtgtttacttctcctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtct

SEQ ID NO: 179635 - DNA, 1724 bp, Homo sapiens
  Payload ID: 15404
  Gene Symbol: SELENBP1
  Gene Name: selenium binding protein 1
  ENST ID: ENST00000443708
  CDS Start-End: 67-438
ccggaacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggcatgtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtcc

SEQ ID NO: 179636 - DNA, 929 bp, Homo sapiens
  Payload ID: 15404
  Gene Symbol: SELENBP1
  Gene Name: selenium binding protein 1
  ENST ID: ENST00000458566
  CDS Start-End: 43-929
gcacagcaaacccgccgggatcaaagtgtaccagtcggcagcatggctacgaaatgtgggaattgtggacccggctactccacccctctggaggccatgaaaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccga

SEQ ID NO: 179637 - DNA, 1611 bp, Homo sapiens
  Payload ID: 15404
  Gene Symbol: SELENBP1
  Gene Name: selenium binding protein 1
  ENST ID: ENST00000427977
  CDS Start-End: 67-438
ccggaacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggcatgtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcatgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggca

SEQ ID NO: 179638 - DNA, 1530 bp, Homo sapiens
  Payload ID: 15404
  Gene Symbol: SELENBP1
  Gene Name: selenium binding protein 1
  Uniprot ID: Q13228
  ENST ID: ENST00000447402
  CDS Start-End: 60-1292
agcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttc

SEQ ID NO: 179639 - DNA, 1887 bp, Homo sapiens
  Payload ID: 15404
  Gene Symbol: SELENBP1
  Gene Name: selenium binding protein 1
  ENST ID: ENST00000423070
  CDS Start-End: 135-632
ctgacaccagcacagcaaacccgccgggatcaaagtgtaccagtcggcagcatgggtcatgtgtctccagctcttcccagcacaacctcaccctcctcagggctctgagggggcggagaggacaggccagagcgatgaggctggagtggggacctaggccagccgcactgccgtggcccgctgggatgtgtgctgcagaacgtgcggagggagccttcaccctccagagcgtggcccagccaatgcgccccattgcttccacagctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggcatgtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttgga

SEQ ID NO: 179640 - DNA, 2562 bp, Homo sapiens
  Payload ID: 15405
  Gene Symbol: SCLY
  Gene Name: selenocysteine lyase
  ENST ID: ENST00000254663
  CDS Start-End: 143-1504
cccgctgggggctcggcggccctctgaagcgggtggattggctggggtgcttcgctcagccaatccggacgcgcccgggcgtcgcggccccgcctcctccccggcgctctgggcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccga

SEQ ID NO: 179641 - DNA, 1774 bp, Homo sapiens
  Payload ID: 15405
  Gene Symbol: SCLY
  Gene Name: selenocysteine lyase
  Uniprot ID: Q96I15
  ENST ID: ENST00000409736
  CDS Start-End: 25-978
atgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcagaggtgaagtgtcaagctgcaggttcaccattcccaaaggcgtcggcagcccccgcaccatcgacgttctgtccccgattggtctgtggggtggccaatccagcacctgccaccagccctccactggggcctgtcctgcttctgcgacagtaaccaggctcaggttttgccgtgcgaaggcagaggtactggttacacctcggcgtctgcaggctgctccctcactgtgcggcctctggtcaaaggccaccaccttcaagcaaccctccatgaaccacagctacattggttcccccatgtcccctgctgtcaccctctatccctgacactgctttatttcccctatctgatgtttctctgtagtgtgttcagatgtatgccccaccttctgcttccccgagagcaggggcttggccatgtcggcctcagtatccccagtacagagaaagggcttagcgcccaggaggccgggccttgggaagagtatgaatggattccctgttacttagaatattcaaaattatattattaacagtgataactgtggctacatttactagaa

SEQ ID NO: 179642 - DNA, 548 bp, Homo sapiens
  Payload ID: 15405
  Gene Symbol: SCLY
  Gene Name: selenocysteine lyase
  ENST ID: ENST00000446202
  CDS Start-End: 36-257
aaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcg

SEQ ID NO: 179643 - DNA, 628 bp, Homo sapiens
  Payload ID: 15405
  Gene Symbol: SCLY
  Gene Name: selenocysteine lyase
  ENST ID: ENST00000423324
  CDS Start-End: 13-228
agtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcagcctactcaatgtgaagatgatgaagatgaagacctttatgatgatctgcttccacttaattaatacggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccc

SEQ ID NO: 179644 - DNA, 660 bp, Homo sapiens
  Payload ID: 15405
  Gene Symbol: SCLY
  Gene Name: selenocysteine lyase
  ENST ID: ENST00000433750
  CDS Start-End: 1-368
agttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggtgatggcccctcaccctggtctttccgagtgtgagcacagctccctcggtgcgtggattctggtccgagccagtgactcccactcgccctgccctgagcatgacacagctcgggctgtcagagggccttgctggggttgccaagagcaggctcgggtggctgtgctgtggtccacagggctctcgccgctggcccctcctctccctgacgtggctcattttgctgctgctgggatgtggactgtggcaaactctcgtgtctggcattagcgccaccccaaaagccgtcagggaaggaagcaacattaaattctagacatttgtcta

SEQ ID NO: 179645 - DNA, 568 bp, Homo sapiens
  Payload ID: 15405
  Gene Symbol: SCLY
  Gene Name: selenocysteine lyase
  ENST ID: ENST00000431487
  CDS Start-End: 1-506
tggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaaggggagagctgcctgccacagagctgagcacgagagtctagcacctgcgctgcctcctaggttggggttccaccctgccccgaaggcttttgtgactctgcgtgtcaaaaggggtggcactcagaggcgccacaaggaagcagcaggactatgcattgcagagcatttctcctgtgtgcccctaagcacttagcatgtatacagagtaggtccttggaaagttcttgttgaataaatgaccaacttttccttcca

SEQ ID NO: 179646 - DNA, 760 bp, Homo sapiens
  Payload ID: 15405
  Gene Symbol: SCLY
  Gene Name: selenocysteine lyase
  ENST ID: ENST00000437134
  CDS Start-End: 1-754
agaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccaaggattcttttctcaaaatgctctggcatttggacacacatcacatgtcgatatttgcataggagtcattttcagtggaataacatttttaatgtgtggttttacggttcaaggaactacttgatgattt

SEQ ID NO: 179647 - DNA, 807 bp, Homo sapiens
  Payload ID: 15405
  Gene Symbol: SCLY
  Gene Name: selenocysteine lyase
  ENST ID: ENST00000416757
  CDS Start-End: 1-456
gcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcaggtgagtgagtgcagggtggccctgggaccagcctgctgagctccagctgcgaggcgggaagtggcctgcgagcagagcccgggatccgctgcagagatgtagattcagtgtgccactcactgtaactcactggttctgatgaggaggcaggccctggcaccttggtgaatagttgcccctcactgcactgggctccctggctgcccctctcggtgcagaggccagctgccacaagggggttggcaagtgtggccaaactttcccttaggaagttcattgagaatgaatatgtagaactagccatttgtataactgagtgatatttgaaacttgcatgtaataaatatttaacctttaaa

SEQ ID NO: 179648 - DNA, 415 bp, Homo sapiens
  Payload ID: 15405
  Gene Symbol: SCLY
  Gene Name: selenocysteine lyase
  ENST ID: ENST00000440143
  CDS Start-End: 1-179
tgggctacctcccatcctcgtgcacacggatgctgcacaggccttggggaagcagcgcgtggatgtggaggacctgggcgtggacttccttacaatcgtggggcacaaggacagagaacaccccaatgattgctggccttgggaaggtgagccctggtgagcttgaggagatgagttgattgctttgtcatcagtgtccccagcggctctagtaggaatctggggctttagggagatcatattcgtgatctcataagcggactgacaagaaaaagcctggaatctgatttatcaacctggagagctgtactttttcagatctgtggattagtggcacttgtttagcatttaaaagggaaaaactccttgtctgtgtctcttctgacatgagaaacagtgatactgttacagcaga

SEQ ID NO: 179649 - DNA, 968 bp, Homo sapiens
  Payload ID: 15405
  Gene Symbol: SCLY
  Gene Name: selenocysteine lyase
  ENST ID: ENST00000443532
  CDS Start-End: 1-330
gatgcgccggcacccgcggcgagtcagcccagcggctgcgggaaacacaactcgccggagaggtgcgcgcctttagggcagggctggggagcggccggcgcctgtcgccgattgtcccgcgcgggaggacgaagggggctcccggcctgtggccgctctcgcgtggggcgtcccgcgcggggatgtccgcgaggtcggcctaagtcagggatgcgagcttcaaggaggagcgggtgcgagctgtggccccgcaagggcccacggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgagtcaaataatttagtaatccattctgtggtgaaacatttccacgcaaaccagacctcaaagggacacacaggtgggcaccacagcccagtgaagggggccaagccccatttcattacttcctcggtggaacacgactccatccggctgcccctggagcacctggtggaagaacaagtggcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaaggtaagtctgcag

SEQ ID NO: 179650 - DNA, 1918 bp, Homo sapiens
  Payload ID: 15405
  Gene Symbol: SCLY
  Gene Name: selenocysteine lyase
  ENST ID: ENST00000450965
  CDS Start-End: 1-726
gtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggggcacaagttttatggtcccaggattggcgcactttatatacgaggacttggtgaatttacccctctctaccctatgctatttggaggtggacaagaacggaatttcaggccagggacagagaacaccccaatgattgctggccttgggaaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccacagcagctgcagctcggtctcgccctccccaggccgtccccagtgctgctgagctacggtgtccccttcgacgtggccaggaacgcgctccggctcagcgtgggccgcagcaccaccagggccgaggtggacctcgtcgtgcaggacctgaagcaggccgtggcgcagctggaggaccaggcctagcactggggccgccttccccaccccgcttctgggaagcccgtggcagggcacagggttgtccctccagttccctcctgagggctgtgccaggatgactgtctcatgccccctctgcattttgtcctggagtgccagcgagtgtgcacccccagtttccttccctggacccctgcagagctcacagggcccaggacaccaacgccgcataggactgcccacatgggaccgcccacataggaccgcccacataggaccgcccacatgggaccgcccacatgggaccgcccacatgggaccgcccacatagaaccgtcctccagtggtgaagcggaaacacttagctttatccaccctccccactgggaactgggcacgcctgttgtgagtgccctttcctggaaggtgtttttatctggaagatagaatccaagtatttataactcattgtcagccaaatgctatcatgaacgtaggaaacttgatttttttgttttgatcatggcctctacatgcacctttccagagtggtctcttctcaggccctttttagtccctttccaaagctgcccccaccaccctgctcctctggcctcagtgcacagtggcccccagcctcggccaggcctgctctgctcagcgcccaccgcccaccacccctcctgcttccccgagcctgaccctgttccgcccactggcaatcagggctgcgcacttccctgtccacggtccccaggccttcctgtcttgtcccttttgatcattattaactcagggtttcagctccaacctcgctgagttggtgcagctccaggtcattcctggggtgggaatcggatcatccctgactcagcttttaccttaattttatttgcagaggattcttttctcaaaatgctctggcatttggacacacatcacatgtcgatatttgcataggagtcattttcagtggaataacatttttaatgtgtggttttacggttcaaggaactacttgatgattttgaggaaacacttgccagaaactaaattaacgaataaaagatttcagtgcccga

SEQ ID NO: 179651 - DNA, 542 bp, Homo sapiens
  Payload ID: 15405
  Gene Symbol: SCLY
  Gene Name: selenocysteine lyase
  ENST ID: ENST00000413463
  CDS Start-End: 31-542
gcccgtagcgctccgcgggaaggaggctggatgcccggcagcagtggggcggggatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcagcggtcacctttgtcccggtgtccaaggtgagcgggcaggcagaggtggacgacatcctcgcggcagtccgcccgaccacacgcctcgtgaccatcatgctggccaacaatgagactggcattgtcatgcctgtccctgaaatcagtcagcgcattaaagccctgaaccaggaacgggtggcagctgggctacctcccatcctcgtgcacacggatgctgcacaggccttggggaagcagcgcgtggatgtggaggacctgggcgtggacttccttacaatcgtggg

SEQ ID NO: 179652 - DNA, 585 bp, Homo sapiens
  Payload ID: 15405
  Gene Symbol: SCLY
  Gene Name: selenocysteine lyase
  ENST ID: ENST00000412508
  CDS Start-End: 1-585
gatggaggcggccgtggcgccggggagggatgcgccggcacccgcggcgagtcagcccagcggctgcgggaaacacaactcgccggagaggaaagtttatatggactataatgcaacgactcccctggagccagaagttatccaggccatgaccaaggccatgtgggaagcctggggaaatcccagcagcccgtattcagcaggaagaaaggccaaggatattataaatgcagctcgggaaagcctcgcgaagatgataggggggaaacctcaagatataatcttcacttccgggggcactgaggccgcggagctggtgacccagaactgcgaggcttatgaggcccacatgagggacgtccgcgactacctggaagagaggctggaagctgaattcggtcagaagagaatccatctgaatagccagtttccaggcacccagcggcttcccaatacctgtaacttttccatccggggaccccggcttcaaggccacgtggtgcttgcgcagtgccgagtgctgatggccagtgtgggggccgcgtgccactcggaccacggggaccagccgtccccagtgctgct

SEQ ID NO: 179653 - DNA, 2387 bp, Homo sapiens
  Payload ID: 15406
  Gene Symbol: SEPHS1
  Gene Name: selenophosphate synthetase 1
  Uniprot ID: P49903
  ENST ID: ENST00000378614
  CDS Start-End: 360-1325
cagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaa

SEQ ID NO: 179654 - DNA, 3273 bp, Homo sapiens
  Payload ID: 15406
  Gene Symbol: SEPHS1
  Gene Name: selenophosphate synthetase 1
  Uniprot ID: P49903
  ENST ID: ENST00000327347
  CDS Start-End: 377-1555
ggccgcacgccgccacccagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctctagtgagataaaccta

SEQ ID NO: 179655 - DNA, 383 bp, Homo sapiens
  Payload ID: 15406
  Gene Symbol: SEPHS1
  Gene Name: selenophosphate synthetase 1
  ENST ID: ENST00000425947
  CDS Start-End: 109-383
cggagctgcttttcagccctaggggcgtgctcaagaatcccccgttactctgatcaaaggacttgctaagtttagaaataaagcgctttacaaatcaaatgcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgt

SEQ ID NO: 179656 - DNA, 660 bp, Homo sapiens
  Payload ID: 15406
  Gene Symbol: SEPHS1
  Gene Name: selenophosphate synthetase 1
  ENST ID: ENST00000413411
  CDS Start-End: 161-660
cgggttccttgctcccctccccggccgcctccgacgcgggcgtcctggagagcgcgccccattgtgcggggccggcggggaggtggatccataaagaacccagccaacccgcagagggaggggaggggctgagctgtgaggagagcggggcccaagaaccatgtctacgcgggagtcctttaacccggaaagttacgaattggacaaaagcttccggctaaccagattcactgaactgaagggcacaggctgcaaagtgccccaagatgtcctgcaaaaattgctggaatctttacaggagaaccacttccaagaagatgagcagtttctgggagccgttatgccaaggcttggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaa

SEQ ID NO: 179657 - DNA, 2988 bp, Homo sapiens
  Payload ID: 15406
  Gene Symbol: SEPHS1
  Gene Name: selenophosphate synthetase 1
  Uniprot ID: P49903
  ENST ID: ENST00000545675
  CDS Start-End: 308-1285
gggccgcacgccgccacccagcagccagggccgcctcttaaagggaggtggccggccttaaaggacccccgcgcgcccagccggcgggagcgcggcggcccggctcccgcagggccgcgccgaggcaggcgagcccccgcggcgcccaggcgcgggcccgggcccccgccgccgccgccgccgccgggcgcggcatttttattcaggcgacgcttaagggagcccggccgcgcccggtgcattgtgggagcggcccgcggcccgttttcgggaggaggcggagggcgcaaagcgagccggcattggaatggatacttgtgtcattcctttgaggcacggtgggctttccttggttcaaaccacagattacatttacccgatcgtagacgacccttacatgatgggcaggatagcgtgtgccaatgtcctcagtgacctctatgcaatgggggtcacggaatgtgacaatatgctgatgctccttggagtcagtaataaaatgaccgacagggaaagggataaagtgatgcctctgattatccaaggttttaaagacgcagctgaggaagcaggaacatctgtaacaggcggccaaacagtactaaacccctggattgtcctgggaggagtggctaccactgtctgccaacccaatgaatttatcatgccagacaatgcagtgccaggggacgtgctggtgctgacaaaacccctggggacacaggtggcagtggctgtgcaccagtggctggatatccctgagaaatggaataagattaaactagtggtcacccaagaagatgtagagctggcctaccaggaggcgatgatgaacatggcgaggctcaacaggacagctgcaggactcatgcacacgttcaatgcccacgccgccactgacatcacgggcttcgggattttgggccatgcgcagaacctggccaagcagcagaggaacgaggtgtcgtttgtaattcacaacctcccggtgctggccaagatggctgcggtgagcaaggcctgcggaaacatgttcggcctcatgcacgggacctgcccggagacttcaggcggccttctgatctgtttaccacgtgagcaagcagctcggttctgtgcagagataaagtcccccaaatatggtgaaggccaccaagcatggattattgggattgtagagaagggcaaccgcacagccagaatcatagacaaaccccggatcatcgaggtcgcaccacaagtggccactcaaaatgtgaatcccacacccggggccacctcttaatctagacagaaatagctgtttggttttgtttttaaatagatctatttcccttatcacttcaattaaagactataaacaacaaaaatctcattgtgtctacacatcggggtgaccttaggtcggtttgtaagtggatacaattaataaaataaaatccattgcctttttttcctgttacattaactgaagatgcacctaatcttgaggcagcttctgagttgagaattatattgttatccaatactgttgattcattttgaatctttagacacttatctcttgccgcataggctttttaaaggtgctttcacatagcacaggcattacccgtagtcgtgtcaaatagcagttggtgtcttcattttatgtatatttatcatataagtctgatttttttttttaagcgtcttgaatggttttctggagagacagcattggtaagtggcacatgacggtatcccagtcataagagggttgcatgattcctttgagtgtttgatttgaaaagcctagtcttgtctctcaagagcatctcggacccagaacattctccagtagtgcattcagttcaacacagcaagtgcttcattgcatggaaaacactttgaagacaaaaaagaaatcttatttctttttttgtagccttcctgatatttacagtaataccattaactgttttatcgatagcaaaaaaggatactttttgcaatgttattagatgttctatagtgctacaaggaattgccttccgaatggaggttcatgtataatactcatttacaattcaatatataattacacaaataatttttaaatataatcaatagtaaagactgttctgtggatggtagtgtttaatacattttctattttgtacagtgatttcaggccttttgttttcttaaaatcagcagctgtttggcctaattcttagcattattttgtcctttgcgccagtacttttttgtgcacgctttttgtgatctgtgttaaaaacctgcattgccaacattgcagctcgaacttaaacttgttattcaaataaatatttaattttttaaattgctcttgtataatcagatgccccttttagtattattttagaagcgttgggagggttttgcctaaagtacaatttatcgggaaaaactagattttagttttataaaacttttaagtctttcatgggacctatattttcttgaattaaattttgtagttctagaataaataggcaatctaaaaaggtgttctctgtgttatgtaaagtggaggcttccttatattttaacctactaagcaatgaggagggattcctgtcattaagcacaagggcgctggatcctcaagtgcccatcttcgtgagagaaaaagcagcacatcctgcccatttctggtgctttctgctcacaggcaccaaagctgcacatgtaaactgacttcttgccaaaggaaatgacccctgggaagttcaagctcctggaagaggctttaactcggacgcgccctcctccaggaaccagtgggcagggcagccttcatgcatgtgtaactggacctccagccataagcatggtgtgcagtatggaagagcctgctacggaactgaaagtgattggacattttataggaattgatagagatgttggtcctcaaaagctacaaaccagtggtctgcaaaataaagtgtgttggaaacctct

SEQ ID NO: 179658 - DNA, 1801 bp, Homo sapiens
  Payload ID: 15407
  Gene Symbol: SEPHS2
  Gene Name: selenophosphate synthetase 2
  ENST ID: ENST00000478753
  CDS Start-End: 455-1801
aatcctgccgatcatgaggtttgccgagtgaccaatcttccctcgtctacaatttgctggacttggaaaagtgactggaagggagcagagttccgtcagccactgccaagaaaccatttaaattactaagagagcgaaggaaagcacgtgacgttctgcaatcccgttgcaagcggttttgcaagccggaggttgttgcaccttttagagtctaggaagcccgcctctcggtggcggagtcgtcattggatgttgcggctgtcaatcgccagggctataaataagggagtccggcggctcctctatcaggaagattgtgcatgccgtgggtctgacggcttgagtagcgctagggagaatccctgcaggtaatatttgacttttgcttcatattaatctgagtggaaaataaaagggccctcttctcctctcgcttccctgccgggcaggcgccatggcggaagcctcggcgacgggcgcctgcggagaggcgatggcagcggcggaaggctcctcgggcccggcgggcttgactctgggccggagcttctcgaactaccggcccttcgagccccaggcgttgggcctcagcccgagctggcggctgacgggcttctccggcatgaagggctgaggctgcaaggtcccgcaggaggcgctgctcaaactcctggcgggactgacgcggccggacgtgcggcccccgctgggccggggcctggtgggtggccaggaagaggcgtcccaggaagccggcctgccggcaggagcgggccccagccccacctttccagccctgggcatcgggatggactcctgcgtcatccccctgaggcacgggggcctgtcactggtgcagaccacggacttcttttaccccttggtagaagatccctacatgatggggcgcatagcttgtgccaacgtgctgagtgacctctacgccatggggattactgagtgtgacaacatgttgatgttactcagcgtcagccagagtatgagtgaggaggaacgcgaaaaggtaacgccactcatggtcaaaggctttcgggatgcggctgaggaaggagggacggcagtgaccggtgggcaaacggtggtcaacccttggattataatcggtggagttgccactgtagtatgccaaccaaatgagttcataatgccggacagcgccgtcgttggggacgtgctggtgttaaccaaaccgttaggaacccaggttgctgtcaatgcccaccaatggctggataatcctgaaagatggaataaagtaaagatggtggtctccagagaagaggtggagctggcctatcaggaagccatgttcaatatggctaccctcaacagaactgctgcaggtttaatgcacacatttaatgcccatgcggccacagatatcacaggctttggcattctaggacactcccagaaccttgcaaaacaacaaagaaatgaagtgtcctttgttattcataatctgccaataattgccaagatggctgccgtcagcaaggccagtggacggtttgggcttcttcaaggaacctcagctgaaacctctgggggattactgatttgtctgccaagagaacaggcggctcgcttttgttctgaaatcaaatcctccaagtacggagagggtcaccaagcgtggatcgttggcattgtggaaaagggaaaccgaacggcccggatcattgacaagccgcgagttattgaagtcctgcctcgtggggccacagctgctgttcttgctcctgacagttcaaatgcctcctctgagcctagctcgtga

SEQ ID NO: 179659 - DNA, 611 bp, Homo sapiens
  Payload ID: 15408
  Gene Symbol:
  Gene Name: selenoprotein K [Source:EntrezGene
  Acc:58515]
  ENST ID: ENST00000488746
  CDS Start-End: 78-296
ggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatag

SEQ ID NO: 179660 - DNA, 1633 bp, Homo sapiens
  Payload ID: 15408
  Gene Symbol:
  Gene Name: selenoprotein K [Source:EntrezGene
  Acc:58515]
  ENST ID: ENST00000495461
  CDS Start-End: 201-485
aagtcgcagatgtgacgatgcaaaaacgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggatgaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagcactgttagtgtcaccttttcaacttctgaaacactgttcattgttaactttttctcatttataaatcactgtatttattttagtagtatgcatagcatatctgtgctcttgaattaatttttatctttaacatatttgtctcatcaatctttaatacactgtgtctaatttgctaccaaatgtaattatcagggtatttataaaaccatagctaacaaaactgagctacaaaatgaaaatttactaaatagtttttaaaatcatggacttcagcctggcgcggtggctcatgcctgtaatcccagcactgtgggaggctgaggcgggcagatcgcctaagttcacgagtttgagaccagcctgcagcatgacgaaacctaaaataacaaaaattagccaggcgtggtagagtgcacctgtaatccctgctactcaggaggcggaggcaggagaatcgcttcaacccgggaggcggaggttgctgtgagcatgccactgcactcctgcctaggcaacagagtgagaccctgtctcaaaaaaataaataaaaccatgggcttccatgctatcttgacaaatttgcactctatagcatcactcaaaatactgcctattggctttaaactccatctgaatactgataactttcacattctttcactagagtggaagctctgagactaggaattttgttgtctttaccccagtcctttgaatagtgactacatgtaagatagtcatgtagtatttattggaaataaatatttattggaaaaacgaaaacagataa

SEQ ID NO: 179661 - DNA, 814 bp, Homo sapiens
  Payload ID: 15408
  Gene Symbol:
  Gene Name: selenoprotein K [Source:EntrezGene
  Acc:58515]
  ENST ID: ENST00000541726
  CDS Start-End: 175-456
cgcccgtcgggggcgcgtctctttcagcagccaatgggctctgcccaccttcgtcctcgtcagcattttgtctaatcgcggcctgtgacgctcgaagggcggggagcagagggagatacagaaaccgacaggggccaggcgcccggtggctccgaagcggggaagtgggacaagatggtttacatctcgaacggacaagtgttggacagccggagtcagtctccatggagattatctttgataacagatttcttctggggaatagctgagtttgtggttttgtttttcaaaactctgcttcagcaagatgtgaaaaaaagaagaagctatggaaactcatctgattccagatatgatgatggaagagggccaccaggaaaccctccccgaagaatgggtagaatcaatcatctgcgtggccctagtccccctccaatggctggtggaggaaggtaaatgtctgctctaagaagcagacaaccggacatgcgcattcatagcagaaggaaaccatcaagaagtggaaggctgaccatgatgagcagtagatgaatgtgtatgtctaaacaaggactgctctgtgtcctcacagatgaatgaggtcatgctgggaattccctctgcagggaactggcctgactgacatgcagttccataaatgcagatgtttgtctcattacctttttgtatagtttattaaagtattaatatagttttaataagtaaatatttttaggttgcagaatggactcctcatctttatattcacgaaaaagcaatctgaagaaaacaaataaaagcctgtgtatttagc

SEQ ID NO: 179662 - DNA, 694 bp, Homo sapiens
  Payload ID: 15409
  Gene Symbol:
  Gene Name: selenoprotein M [Source:EntrezGene
  Acc:140606]
  ENST ID: ENST00000400299
  CDS Start-End: 64-501
agacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaa

SEQ ID NO: 179663 - DNA, 1054 bp, Homo sapiens
  Payload ID: 15409
  Gene Symbol:
  Gene Name: selenoprotein M [Source:EntrezGene
  Acc:140606]
  ENST ID: ENST00000402395
  CDS Start-End: 419-856
ggaagaaaccgaggcccagggattacacagccagtagagagaggacagagcatggagctcctggagaggcagtggataattcttcccgacagaggagctgactgttgaaccccttctttgaaggagagtccgtgctgccaaatcgaagaagagaaacgccctggctggaaagcagagagaacagcagtcgcaggttcggctcagaaactccagtgtccctcagcgtctcgccggcaccctctgccggcgtgaggtggcgctgcctggccgcatcctgggggagcgtccacatcctcggtcgacaaaaggagcgtcgacactctcggacctgggaaagtgacggcccaaacgccagggaggagccaggacctcgccctgagctagcgggagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggatgacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactgag

SEQ ID NO: 179664 - DNA, 689 bp, Homo sapiens
  Payload ID: 15409
  Gene Symbol:
  Gene Name: selenoprotein M [Source:EntrezGene
  Acc:140606]
  ENST ID: ENST00000611680
  CDS Start-End: 64-498
agacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagagacctgcgggggacagctgaaccgcctaaaggaggtgaaggctttcgtcacgcaggacattccattctatcacaacctggtgatgaaacacctccctggggccgaccctgagctcgtgctgctgggccgccgctacgaggaactagagcgcatcccactcagtgaaatgacccgcgaagagatcaatgcgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgcctt

SEQ ID NO: 179665 - DNA, 4227 bp, Homo sapiens
  Payload ID: 15410
  Gene Symbol: SEPN1
  Gene Name: selenoprotein N, 1
  ENST ID: ENST00000354177
  CDS Start-End: 56-1726
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccaaagctgtcactgttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagact

SEQ ID NO: 179666 - DNA, 4334 bp, Homo sapiens
  Payload ID: 15410
  Gene Symbol: SEPN1
  Gene Name: selenoprotein N, 1
  Uniprot ID: Q9NZV5
  ENST ID: ENST00000361547
  CDS Start-End: 56-1828
ccccgccccgctctttcgcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcttgttctgtcacccagactggagtgcagtggtgcagtcacagctcactgcagcctcaacttccctggctcaattgatcctcctgcctcagcctcctgaggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaacta

SEQ ID NO: 179667 - DNA, 4212 bp, Homo sapiens
  Payload ID: 15410
  Gene Symbol: SEPN1
  Gene Name: selenoprotein N, 1
  Uniprot ID: Q9NZV5
  ENST ID: ENST00000374315
  CDS Start-End: 39-1709
gcttcccgggccgccggcagccgccgccagccgcagccatgggccgggcccggccgggccaacgcgggccgcccagccccggccccgccgcgcagcctcccgcgccaccgcgccgccgcgcccgttccctggcgctgctcggagccctgctggccgccgccgctgccgccgccgtccgggtctgcgcccgccacgccgaggcccaggcggccgcgcggcaggaactggcgctgaagaccctggggacagatggcctttttctcttttcctccttggacactgacggggatatgtacatcagccctgaggagttcaaacccattgctgagaagctaacagggtcaactcccgcggccagctgcgaggaggaggagttgccccctgaccctagcgaggagacgctcaccatagaagcccgattccagcctctgctcccggagaccatgaccaagagcaaagatggcttcctaggggtctcccgcctcgccctgtccggcctccgaaactggacagccgccgcctcaccaagtgcagtgtttgccacccgccacttccagcccttccttcccccgccaggccaggagctgggtgagccctggtggatcatccccagtgagctgagcatgttcactggctacctgtccaacaaccgcttctatccaccgccgcccaagggcaaggaggtcatcatccaccggctcctgagcatgttccaccctcggccctttgtgaagacccgctttgcccctcagggagctgtggcctgcctgactgccatcagcgacttctactacactgtgatgttccggatccatgccgagttccagctcagtgagccgcccgacttccccttttggttctcccctgctcagttcaccggccacatcatcctctccaaagacgccacccacgtccgcgacttccggctcttcgtgcccaaccacaggtctctgaatgtggacatggagtggctttacggggccagtgaaagcagcaacatggaggtggacatcggctacataccccagatggagctggaggccacgggcccctctgtgccctccgtgatcctggatgaggatggcagcatgatcgacagccacctgccttcaggggagcccctgcagtttgtgtttgaggagatcaagtggcagcaggagctgagctgggaggaggctgcccggcgcctggaggtggccatgtaccccttcaagaaggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagactaa

SEQ ID NO: 179668 - DNA, 2994 bp, Homo sapiens
  Payload ID: 15410
  Gene Symbol: SEPN1
  Gene Name: selenoprotein N, 1
  ENST ID: ENST00000630065
  CDS Start-End: 293-493
ggtctcctacttgccgttcactgaggccttcgaccgagccaaggctgagaacaagctggtgcactcaatcctgctgtggggggccctggatgaccagtcctgctgaggttcagggcggactctccgggagactgtcctggaaagttcgcccatcctcaccctgctcaacgagagcttcatcagcacctggtccctggtgaaggagctggaggaactgcagaacaaccaggagaactcgtcccaccagaagctggctggcctgcacctggagaagtacagcttccccgtggagatgatgatctgcctgcccaatggcaccgtggtccatcacatcaatgccaactacttcttggacatcacctccgtgaagcccgaggaaatcgagagcaatctcttcagcttctcatccacctttgaagacccgtccacggccacctacatgcagttcctgaaggagggactccggcgtggcctgcccctcctccagccctagagtgcctggacgggatctgatgcacaggcccccacgcctcagagccagagtggtcctcagcccatttcagactgcagatgccgcccactcccaccccactcctaggctgccttggagggtacaagatccactgagggtggccaccacagccttggctccatggtggcgggtagacaagggatgcctgggctgactgggcagaggaacctctagctctgactgtcactcggctctccctacccatttggctctggaagctgcttggcccccccagatcagggcctgggtgaactccctggacctttcctagccagccgcacagtctaggcccttgtggggtgaagaatggagggaggagcaggctaggaagacggggccaccaccctctccttgctttcagcccttcccacaggaaacatcaagaagccccagccaggaggggccaggctgccaaggcggctcccctgtttatctagagccttcgttcctggccataccccggactgccctcctgtgcctgatgtccccagctggggtcagtctcaacaggagccagtcttctggagcctctgggcagaaccctccatcagagtggaaatcagacgggaccccctgcagcttccctgaccacgccactgaccagctatctggggaagtttactgtgaaggggtttctgcctttagcaatggggttcactaagggggttcccgaggcccagggccaaggcactcccaccgcctaccttagcacagggtctctgcaggactgcgggagccagcgctcctgccgcccctcttgcccctcagaccttgcatccacagaagcacaacccagccaaacaccacagccttctccagagccggcactgtcccggcaaccaggggtgccccaggctagctcttctacctctggggcaccacggactccccttggccactcttgggactttggtccacgtcctgagccactgaccacggccagtctctctttttatatgtgcagaaaagtgtttttacacaaactttctcatggtttgtaggtatttttttataaccccagtgctgaggagaaaggaggggcagtggcttccccggcagcagccccatgatggctgaatccgaaatcctcgatgggtccagcttgatgtctttgcagctgcacctatgggaagaagtagtcctctcttccttctcctcttcagctttttaaaaacagtcctcagaggatccatgatccccagcactgtcccatcctccacaaaggcccacaggcatgcctgtactctctttcattaaggtcttgaagtcaggctgccccctccccagcccccagttctctccccaccccctcaccccacccggggctcactcagcctggcagaggaagaaggaaggcagacatctccgcagccactcctgggccttttatgtgccgagttaccccacttgccttgggcgtgtccactgagccttccccagccagtcttgttctcaattttgttttgttttgttttgagacggagtcttgctctgtcacccaggctggagtgctatggctcgatcttggctcactgcaacctccacctcccaggttcaagcaattctcttgcctcagcctcccgagtagctgggattacaggtgcatgccaccatggctggctaatttttgtatttttagtagagatggggtttcaccatattggtcaggctgatctggaacttctgacctcaggtgatccacctgcctcagcctcccaaagtgctgggattacaggcgtgagcaatcgtgcccagccttgttcttaattttgtatcatccagtcatcgctaatattacacgcaccttctcacttaatcctcacgacaagcctgtgaggcagatgctcattgttcccatcttgatgaaacttgagtctcagggaagtgaagtgacttgcccagggtcactcaggtagagttgagattcaaacccacatgtggctccaaagtctgcatctggatttgggggtgttttttggcatggcaccctcacctctctccctgcctgttttccccaaagtggaaaggaaggcctttcaaaccagagtgtctcactcccctctgacctccagaccagatggggcatgagccagccagctcagccaggctccctgtgtcctgggaggaagtgtccccatcccccatgccccttatggggagggagggcgtctgatgctctctctctgcctccccccccatcctgtcaggcacaggtgacgggggcagcccatgcgagcccttctcctgctgctctgggagggccagttccacattgagccagcctggtcccatggaaaatgatggcctgggctttctgaggccttatctgatgcctctgcagttcatgtcccccaccaggcctcgaggctcagggtgggagagggccccgggctgccctgtcactcctctaacacttccctcccctgtccccaacatgccctgtaataaaattagagaagact

SEQ ID NO: 179669 - DNA, 2315 bp, Homo sapiens
  Payload ID: 15411
  Gene Symbol:
  Gene Name: selenoprotein O [Source:EntrezGene
  Acc:83642]
  ENST ID: ENST00000380903
  CDS Start-End: 59-2068
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatgatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcga

SEQ ID NO: 179670 - DNA, 2311 bp, Homo sapiens
  Payload ID: 15411
  Gene Symbol:
  Gene Name: selenoprotein O [Source:EntrezGene
  Acc:83642]
  ENST ID: ENST00000611222
  CDS Start-End: 59-2065
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccggtcccgagggcgccccgtccgcgccgcggcccgtgcccggggcctgcttcacccgcgtgcagcccaccccgctgcggcagccgcgcctcgtggcgctgtcagagcccgcgctggcgttgctgggcctgggcgcgccgcccgcgcgcgaggccgaggccgaggccgcgctgttcttcagcggcaacgcgctcctgccgggcgccgagcccgccgcgcactgctactgcggccaccaattcggccagttcgccgggcagctgggcgacggcgccgccatgtacctgggcgaggtgtgcacggcgaccggcgagcgctgggagctgcagctcaagggcgccgggcccacgcccttctccagacaggccgacggtcgcaaggtcctacggtcaagcatccgggagtttctatgcagcgaagccatgttccacctgggagtccccaccacacgggccggcgcctgcgtcacgtccgagtccacggtggtgcgcgacgtgttctatgatggtaatcccaaatatgaacaatgcacggttgtgttgcgtgtagcttccactttcataaggtttggatcctttgagatttttaagtctgcagatgagcacacagggcgtgcaggccccagcgtggggaggaacgacattcgagtgcagctgctcgactatgtcatcagctccttttaccccgagatccaggctgctcatgccagcgacagcgtgcagagaaatgctgccttcttccgggaggtgacgcggcgcacggcgcggatggtggccgagtggcagtgtgtgggcttctgccacggcgtgctcaacaccgacaacatgagcatcctggggctcaccatcgactacgggccctttggcttcctggacaggtacgaccccgaccacgtgtgcaatgcctccgacaacaccggccgctacgcgtacagcaagcagcccgaggtgtgcaggtggaacctgcggaagctggccgaggccctgcagccggaactgcccctggagctgggggaggccatcctggccgaggagtttgacgccgagttccaaaggcactacctgcagaagatgcgcaggaagctgggcctcgtgcaggtggagctggaggaagacggggcgctggtgtccaagctcctggagaccatgcatctgaccggtgccgacttcacaaacaccttctacttgctgagctccttcccagtggagctagagtcgccaggcctggcggaattcctggccaggctgatggagcagtgtgcctccctggaggagctgaggctggccttccggccccagatggatccccggcagctatccatgatgctgatgctggcgcagtcaaacccgcagctgttcgcgcttatgggcacccgggcaggcatcgccagggagctggagcgtgtggagcagcagtctcggctggagcagctgagtgcggcagagctgcagagcaggaaccagggccactgggctgactggctacaggcgtacagagcccggctggacaaggacctggaaggcgctggggacgctgccgcctggcaggctgagcacgtgcgcgtgatgcacgccaacaacccgaagtacgtgctgaggaactacatcgcgcagaatgccatcgaggctgccgagcgcggggacttctcagaggtgcggcgggtgctgaaactactggagaccccttaccactgcgaggcgggggccgccacagacgccgaggccacggaagccgacggggcggacggcaggcagcgctcctacagcagtaagcccccgctctgggcagcagaactgtgcgtgacatcttcgtaacggcctcggcacgctccacacccctggagtctcccgaggcccccatgtgctgctgagtggccaagatgatgccaggctgccctatacactgggggattctgccctggcccatgcacacccgtctttccatgatggcagagacatccagtcaggacctgacccgtctctgtctgaggccggctcagcagtgcagcctggtccctgggggctggacccaggctcctaaataaaccagcaactccctcg

SEQ ID NO: 179671 - DNA, 2243 bp, Homo sapiens
  Payload ID: 15412
  Gene Symbol: SEPP1
  Gene Name: selenoprotein P, plasma, 1
  Uniprot ID: P49908
  ENST ID: ENST00000514985
  CDS Start-End: 258-1403
gtcaaaatgttttccccatattatgcatggcagcacttgctactttcttttaagttgataacaatcagctcaggggtttgctctgcttgcaaggtcactgcaagaatgaacattgaactttggactatacctgaggggtgaggtaaacaacaggactataaatatcagagtgtgctgctgtggctttgtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatcatactcttctaaaacttgagtggctgtcttaaaagatataaggggaaagataatattgtctgtctctatattgcttagtaagtatttccatagtcaatgatggtttaataggtaaaccaaaccctataaacctgacctcctttatggttaatactattaagcaagaatgcagtacagaattggatacagtacggatttgtccaaataaattcaataaaaaccttaaagctga

SEQ ID NO: 179672 - DNA, 1047 bp, Homo sapiens
  Payload ID: 15412
  Gene Symbol: SEPP1
  Gene Name: selenoprotein P, plasma, 1
  ENST ID: ENST00000514218
  CDS Start-End: 116-1047
caggagcatgacgagggagagaggtcatcgaggctggggtgagacatctgacttaccgtcaggagccacgtcagtgcctcataaaatccaatctccattcaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaa

SEQ ID NO: 179673 - DNA, 2204 bp, Homo sapiens
  Payload ID: 15412
  Gene Symbol: SEPP1
  Gene Name: selenoprotein P, plasma, 1
  Uniprot ID: P49908
  ENST ID: ENST00000506577
  CDS Start-End: 470-1615
acagacaggcaggtgcaggagacggggtgagcgcttttgggctctagccccatggcagcatctaggggtgtgttacaattaatgctcttttagcagttgctgttcgcggatggctaagtgttaaaccagctcagtggagagtcagggtggcagccttttacgccctgtcctcttggtacccgggtctttgtctagcatccaggaagaatcaggtcctacagacttgaaggatggtgaatacagagattttattgaatgatggaggaggctttcagcaggatggatggggagctggaaagcggatggagtgagaagataatcttcccctggggtttggccatcccatggctgatctctctgacagtccccagccgaactcctctcgatgttcagacactctttctcctctctcctctgccacactgctctgctgctcttctgctcatggagcctgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatcttt

SEQ ID NO: 179674 - DNA, 787 bp, Homo sapiens
  Payload ID: 15412
  Gene Symbol: SEPP1
  Gene Name: selenoprotein P, plasma, 1
  ENST ID: ENST00000510965
  CDS Start-End: 160-787
tgtggagctgccagagtaaagcaaagagaaaggaagcaggcccgttggaagtggttgtctacttgcaatatgtgctctgggctggacgcggtggctcacgcttgtaatcccagcactttgggaggccaaggcaggcggatcacgaggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatc

SEQ ID NO: 179675 - DNA, 1853 bp, Homo sapiens
  Payload ID: 15412
  Gene Symbol: SEPP1
  Gene Name: selenoprotein P, plasma, 1
  Uniprot ID: P49908
  ENST ID: ENST00000511224
  CDS Start-End: 100-1245
gtggagctgccagagtaaagcaaagagaaaggaagcaggcccgttggaagtggttgtttaagttcttatcaagatatcatatataggacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaattagaagacctgcgagtaaaactgaagaaagaaggatattctaatatttcttatattgttgttaatcatcaaggaatctcttctcgattaaaatacacacatcttaagaataaggtttcagagcatattcctgtttatcaacaagaagaaaaccaaacagatgtctggactcttttaaatggaagcaaagatgacttcctcatatatgatagatgtggccgtcttgtatatcatcttggtttgcctttttccttcctaactttcccatatgtagaagaagccattaagattgcttactgtgaaaagaaatgtggaaactgctctctcacgactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctccagctgcctgacaaataagtcagcagcttatacccacagaagccagtgccagttgacgctgaaagaatcaggcaaaaaagtgagaatgaccttcaaactaaatatttaaaataggacatactccccaatttagtctagacacaatttcatttccagcatttttataaactaccaaattagtgaaccaaaaatagaaattagatttgtgcaaacatggagaaatctactgaattggcttccagattttaaattttatgtcatagaaatattgactcaaaccatattttttatgatggagcaactgaaaggtgattgcagcttttggttaatatgtctttttttttctttttccagtgttctatttgctttaatgagaatagaaacgtaaactatgacctaggggtttctgttggataattagcagtttagaatggaggaagaacaacaaagacatgctttccatttttttctttacttatctctcaaaacaatattactttgtcttttcaatcttctacttttaactaataaaataagtggattttgtattttaagatccagaaatacttaacacgtgaatattttgctaaaaaagcatatataactattttaaatatccatttatcttttgtatatctaagactcatcctgatttttactatcacacatgaataaagcctttgtatctttctttctctaatgttgtatc

SEQ ID NO: 179676 - DNA, 786 bp, Homo sapiens
  Payload ID: 15412
  Gene Symbol: SEPP1
  Gene Name: selenoprotein P, plasma, 1
  ENST ID: ENST00000507920
  CDS Start-End: 71-586
gtggagctgccagagtaaagcaaagagaaaggaagcaggcccgttggaagtggttgtgacaaccccagcaatgtggagaagcctggggcttgccctggctctctgtctcctcccatcgggaggaacagagagccaggaccaaagctccttatgtaagcaacccccagcctggagcataagagatcaagatccaatgctaaactccaatggttcagtgactgtggttgctcttcttcaagccagctgatacctgtgcatactgcaggcatctaaactctcaaagatgaagacttttgtaaacgtgtatctttggctactgtggataaaacagttgaaactccatcgcctcattaccatcatgagcatcatcacaatcatggacatcagcaccttggcagcagtgagctttcagagaatcagcaaccaggagcaccaaatgctcctactcatcctgctcctccaggccttcatcaccaccataagcacaagggtcagcataggcagggtcacccagagaaccgagatatgccagcaagtgaagatttacaagatttacaaaagaagctctgtcgaaagagatgtataaatcaattactctgtaaattgcccacagattcagagttggctcctaggagctgatgctgccattgtcgacatctgatatttgaaaaaacagggtctgcaatcacctgacagtgtaaagaaaacctcccatctttatgtagctgacagggacttcgggcagaggagaacataactgaatcttgtcagtgacgtttgcctcca

SEQ ID NO: 179677 - DNA, 819 bp, Homo sapiens
  Payload ID: 15413
  Gene Symbol:
  Gene Name: selenoprotein T [Source:EntrezGene
  Acc:51714]
  ENST ID: ENST00000492132
  CDS Start-End: 36-173
gtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgagatggagtctcactgtattgcctaggctggtcttgaactcctgggatcaagtgaacctcctgcctcagcctcccaaagtgctgggattacagattgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgtta

SEQ ID NO: 179678 - DNA, 783 bp, Homo sapiens
  Payload ID: 15413
  Gene Symbol:
  Gene Name: selenoprotein T [Source:EntrezGene
  Acc:51714]
  ENST ID: ENST00000480740
  CDS Start-End: 168-581
caggagaaagcaatattgtaagatcaaagaaaaggccataacagcgcacccaaaaaatttcagcattaccattctgagggtcaggagtctcctcccttccatccgccaacacttgaatcaggactataaatgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacatt

SEQ ID NO: 179679 - DNA, 944 bp, Homo sapiens
  Payload ID: 15413
  Gene Symbol:
  Gene Name: selenoprotein T [Source:EntrezGene
  Acc:51714]
  ENST ID: ENST00000477889
  CDS Start-End: 467-880
agcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgagatggagtctcactgtattgcctaggctggtcttgaactcctgggatcaagtgaacctcctgcctcagcctcccaaagtgctgggattacagatgtgagccacgatgcccagcctatgatagactttaaaaagcacaaaaccaatttgaaatagcatggacaagagattttgctgtattttcgaaatttcctttctgttctgcatagatcatctaatattgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactga

SEQ ID NO: 179680 - DNA, 3469 bp, Homo sapiens
  Payload ID: 15413
  Gene Symbol:
  Gene Name: selenoprotein T [Source:EntrezGene
  Acc:51714]
  ENST ID: ENST00000471696
  CDS Start-End: 76-663
gggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctg

SEQ ID NO: 179681 - DNA, 1078 bp, Homo sapiens
  Payload ID: 15413
  Gene Symbol:
  Gene Name: selenoprotein T [Source:EntrezGene
  Acc:51714]
  ENST ID: ENST00000485923
  CDS Start-End: 389-802
gcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttggtgagtatgtgcactgggccccggccaccccgccgcgcctctgctcggcgccattggctacgcgaggccccggcttcgcggcctaaatggccgcatcttcgctggcctcgtagaactgtgccggcgcccttccacagccagccttctcgcggccccttagcgcggtcaggccgccctccttttccagtgtttcctgaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgtttt

SEQ ID NO: 179682 - DNA, 3488 bp, Homo sapiens
  Payload ID: 15413
  Gene Symbol:
  Gene Name: selenoprotein T [Source:EntrezGene
  Acc:51714]
  ENST ID: ENST00000615547
  CDS Start-End: 85-672
tgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgggttagttcaggttataggcgggtgtttgaggagtacatgcgggttattagccagcggtacccagacatccgcattgaaggagagaattacctccctcaaccaatatatagacacatagcatctttcctgtcagtcttcaaactagtattaataggcttaataattgttggcaaggatccttttgctttctttggcatgcaagctcctagcatctggcagtggggccaagaaaataaggtttatgcatgtatgatggttttcttcttgagcaacatgattgagaaccagtgtatgtcaacaggtgcatttgagataactttaaatgatgtacctgtgtggtctaagctggaatctggtcaccttccatccatgcaacaacttgttcaaattcttgacaatgaaatgaagctcaatgtgcatatggattcaatcccacaccatcgatcatagcaccacctatcagcactgaaaactcttttgcattaagggatcattgcaagagcagcgtgactgacattatgaaggcctgtactgaagacagcaagctgttagtacagaccagatgctttcttggcaggctcgttgtacctcttggaaaacctcaatgcaagatagtgtttcagtgctggcatattttggaattctgcacattcatggagtgcaataatactgtatagctttccccacctcccacaaaatcacccagttaatgtgtgtgtgtgttttttttttaaggtaaacattactacttgtaactttttttcttagtcatatttgaaaaagtagaaaattgagttacaatttgattttttttccaaagatgtctgttaaatctgttgtgcttttatatgaatatttgttttttatagtttaaaattgatcctttgggaatccagttgaagttcccaaatactttataagagtttatcagacatctctaatttggccatgtccagtttatacagtttacaaaatatagcagatgcaagattatgggggaaatcctatattcagagtactctataaatttttgtgtatgtgtgtatgtgcgtgtgattaccagagaactactaaaaaaaccaactgctttttaaatcctattgtgtagttaaagtgtcatgccttgaccaatctaatgaattgattaattaactgggcctttatacttaactaaataaaaaactaagcagatatgagttaaatttaaaagtttcaatttattgctcagtgtacctgttaacattatatttaacaattgcttaaatttttgtttttgatttatggataatttcttaagagtacacactttagatacacaaataatcgttcatttaccatctttaggatcattgaaactcatctcactaaagaaagttcacttgaacctctttatagcattgatactaggtgaacagaaattacctgactaataatttgtctaacatcatatatcagaattttattgtatatgatgaacaaaacttaaaattttttaaatttaatttttaaatactgtttcagagttctaaaaaggcagttttttaaaaaacttaagttgataaaaactgtaagaataatttagcagaaatagaaccagaatgtagaagagtagtcatgtaacagcagtaataacatacttcagcttccatataggaatagaagtggtagagccaaaagtgatttaggaaaagttataaggtacaggttgagtatcccttttccaaaaatgcttgggacaagaagtatttcagatttcataatttttttcaaagtttggaatatttgcattatacttaccagttgggcatcccaaatctgaaatctgaaatgttccatgagcatttcctttgagtgtcatgttggcactcaaaaaggttcaacattgagtccacttaacacttaggtgttagaagacctaactttctgtaacaattaaccttatactttgtttgtcatcgaatatttgttgaatgcatgtcaggtaatggtcttgattgtgatagcttcaaggtggaacatactgtaatctccagatgctaggaagttagtctaataattcactgcagaaaattgattaagtggctgtccttttaattaagagtgtggagtcataaacttaagttcttcatatagtgacaagagtccttagagattgttattcaagttccttagaaattgttatttaggtataatatcatcttgtctttgactagagcttgaaaccttgttatctgattgtgtaccactccaaattccctgccttctgcaagttgaatgtcttgctgaatgtgtctaggggttcatcttcagtaatcgacattccactagtgccatagttaacttcatgacatgtagacattcaaaacttgagccttggatgttcctgtggacctgacagttaaaaatataaagaacctaggattcaattccaactttctctgtttgccttgggttgaataacttatcttttggagaatagctttaagtggcttagacactgataaaattcagctgtgttgttgacgctcatctcttttgtcttacgcttagccatatttaaatcttgaatttaatagagtctagtgaaaaaaatgagtgggaagaatgaatataaaagtaataatataaggaaaaagggaaagtaaactatttagaatgtagttttgttatattcccagcatttcaatatttattagttacttgtaaattactgtggctgtgtagtttataaatgtctgtgcactatattaattagaagaccatagaacatgccagcaggttggctaatgctatgggggtttttaccacagttgccattgtggaagaaattatttggtacattaataaaaaaagttggtaaaacatggttttatacctcagtgtataagatgtgcaagacaaatatgcttatttccttttctagaatataagtgatattatttgcttatgacactaacactattaatgacaggagtcaatcagcctttacagctatcaaaatataatgagatcccaatgatgattcttttttactttgaatgttaattagtttgggactttgattggctggcaaacattttatcattgtcagaatttaatttagatttcaaaaatagcttacaggattttaaacatggtgtggtattctaaagccttttttttaaaaaaagagatctttttgagagaaacaaatgaggattgtaaagtttggggacttacctctgtagcattgtgaaaataaactttgattaagctgatttgaaagg

SEQ ID NO: 179683 - DNA, 1704 bp, Homo sapiens
  Payload ID: 15414
  Gene Symbol:
  Gene Name: selenoprotein V [Source:EntrezGene
  Acc:348303]
  ENST ID: ENST00000335426
  CDS Start-End: 101-1141
cgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgtggcctctgaagctatagccttcggtacattctactgaaaaagagcctggagcagcaatttccgaatcacctactctttgaggaggacagagctgcccaggctacaggggagtttgaggtgtttgtgaacgggagactggtccattccaagaagaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgt

SEQ ID NO: 179684 - DNA, 1701 bp, Homo sapiens
  Payload ID: 15414
  Gene Symbol:
  Gene Name: selenoprotein V [Source:EntrezGene
  Acc:348303]
  ENST ID: ENST00000423711
  CDS Start-End: 101-1138
cgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgtggcctcagctatagccttcggtacattctactgaaaaagagcctggagcagcaatttccgaatcacctactctttgaggaggacagagctgcccaggctacaggggagtttgaggtgtttgtgaacgggagactggtccattccaagaagaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgt

SEQ ID NO: 179685 - DNA, 481 bp, Homo sapiens
  Payload ID: 15414
  Gene Symbol:
  Gene Name: selenoprotein V [Source:EntrezGene
  Acc:348303]
  ENST ID: ENST00000600586
  CDS Start-End: 1-221
actcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactgtacattctactgaaaaagagcctggagcagcaatttccgaatcacctactctttaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagca

SEQ ID NO: 179686 - DNA, 1704 bp, Homo sapiens
  Payload ID: 15414
  Gene Symbol:
  Gene Name: selenoprotein V [Source:EntrezGene
  Acc:348303]
  ENST ID: ENST00000622070
  CDS Start-End: 101-1141
cgccgcgtctcagaacccggtgcgggagacgctctccccgcccaaagagggaaggcgggcgggactccccaaccggcttgccccggtccccctgggccccatgaataaccaggcgcggaccccagccccctcctcggcgcggacttcaacctcagtccgggcttctaccccgacccggacaccgactccactccggaccccgactccggtccggactcggacccccatccggaccctgactccagtcctgactccgtctccagccgggacttcccctctggtcctgactcctgctccagcccagattcccactctggtccccactcccgctctggcccggatcccccgtctggttccgcctcctgctccggcctggatccctactccggtgccgactcccgttcccgtccggaacccaactccggtcccgactccggctcggaccctgactcctccagtccgggtcccagccccagccccagcccagctcctggcagggattcgggccgcgctccccgtcttggactcctacctggccccggccctacctttggatccgcccccggaacctgctccggagctgcctttgttgcccgaggaggaccctgagccggcgccgagcctgaagctcatcccgtcggtctccagcgaggccgggcccgccccggggccccttcccacgcgcaccccgctggccgcgaactcacccgggcccaccctggacttcaccttcagggcagacccgtcggccatcgggctggcggatccccccattcccagtcctgtcccctcgcccatcctggggaccatcccgtcggccatctccttacagaattgtacggaaaccttcccctcctccagcgagaacttcgcgctggacaagagggtcctgattcgagtgacctactggattctgaacagctatagccttcggtacattctactgaaaaagagcctggagcagcaatttccgaatcacctactctttgaggaggacagagctgcccaggctacaggggagtttgaggtgtttgtgaacgggagactggtccattccaagaagaggggtgatggctttgtgaacgagtccaggctgcagaaaattgtgagcgttatcgatgaggaaatcaagaaaaggtagccggcaaggggtggagctggaggagtctcagctggatgatgagaagggctgaaatgttgccaagtcaggtccttttctgatggtggctggggctggggtgagctcagggaggggaagaggagaatacatgcagagtcagcacccctgtgtccagtctgactgtgtctgctgtcgccacactcacctctgaggtctgtggaagtcacctgatattctggccccaggggtgggagggaggggagcttggaaggctagtcctgtagctccagtcctctgtctggcctccactcctcttgctcctgagggcagtttgtttcttttgtggattcgtcatttcccatgccctggttccagatacattttgaaaaccttccatcttattggcattttctggggttgtgagggaaacggggatggcagtcagactcaaacccgtgacactccaaactcgattatgctccagggcccactttctaaacctgtaagatctatgttccagcctgcgcaacatagtgagaccccaactctacaaaaaataaaaaattagccaggtgtggtggtgt

SEQ ID NO: 179687 - DNA, 881 bp, Homo sapiens
  Payload ID: 15415
  Gene Symbol: SEPW1
  Gene Name: selenoprotein W, 1
  ENST ID: ENST00000509570
  CDS Start-End: 202-468
gcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgctgcggggccggaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaactg

SEQ ID NO: 179688 - DNA, 636 bp, Homo sapiens
  Payload ID: 15415
  Gene Symbol: SEPW1
  Gene Name: selenoprotein W, 1
  ENST ID: ENST00000599874
  CDS Start-End: 86-343
tctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatcgtgagtcttgggatggggagaaagacttgagcacagccactgtgtcggtccgttaggcctggatggcactgcaggggggttagtgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtc

SEQ ID NO: 179689 - DNA, 535 bp, Homo sapiens
  Payload ID: 15415
  Gene Symbol: SEPW1
  Gene Name: selenoprotein W, 1
  Uniprot ID: P63302
  ENST ID: ENST00000595615
  CDS Start-End: 86-349
gcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagaggtgagggggcccactagacagggacaccaccctttggatcttctccctgccccatgctctgactccttggcccagggtggagagcctgggagatgggggggacatcacgtgtgtccccagagcgagcgggataaagttagacccggttggtggaggacaacaactgag

SEQ ID NO: 179690 - DNA, 550 bp, Homo sapiens
  Payload ID: 15415
  Gene Symbol: SEPW1
  Gene Name: selenoprotein W, 1
  Uniprot ID: P63302
  ENST ID: ENST00000593892
  CDS Start-End: 110-373
atcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggaca

SEQ ID NO: 179691 - DNA, 888 bp, Homo sapiens
  Payload ID: 15415
  Gene Symbol: SEPW1
  Gene Name: selenoprotein W, 1
  Uniprot ID: P63302
  ENST ID: ENST00000601048
  CDS Start-End: 215-478
gggctggcgggtcgcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgcttgaggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaa

SEQ ID NO: 179692 - DNA, 875 bp, Homo sapiens
  Payload ID: 15415
  Gene Symbol: SEPW1
  Gene Name: selenoprotein W, 1
  ENST ID: ENST00000612212
  CDS Start-End: 202-462
gcgggttccttatcctccgccttggcgcctctccgcccaccgcccaccgcccctccctggcattggttggcgccaggggaagccgaggctccatcctttctgcgcaggttcccgccgcactcgcgcagacctagcgcgtccaggtgggaggttagtgtggcccgggcgtccgctcctcagcggatgtggcagccccgagccatggctctcgccgtccgagtcgtttattgtggcgctggctacaagtccaagtatcttcagctcaagaagaagttagaagatgagttccccggccgcctggacatctgcggcgagggaactccccaggccaccgggttctttgaagtgatggtagccgggaagttgattcactctaagaagaaaggcgatggctacgtggacacagaaagcaagtttctgaagttggtggccgccatcaaagccgccttggctcagggctaatgcgccctgaaggcagagtccagggaccttgacccagcccctctcagcagacgcttcatgataggaaggactgaaaagtcttgtggacacctggtctttccctgatgttctcgtggctgctgttgggggcagagattgacgcccccggtctttgcctctgagcgggagagtctgtgtgtatgtgtcttccccggaatccacaccaccccaccctcctcctgtcccgtggtttcatcatatctctttgcataccccatgtcttccccagttgtcccctggagtttggggggacatcccgcctcaggcatccttctcaaggggaagccaagagaggcatcaggatgggtgggtttctgattgtggcaacgtttgcaaccgttcacgattcaataaatattggatgaatttaactg

SEQ ID NO: 179693 - DNA, 8225 bp, Homo sapiens
  Payload ID: 15416
  Gene Symbol: SEMA3A
  Gene Name: sema domain, immunoglobulin domain (Ig), short basic domain, secreted, (semaphorin) 3A
  Uniprot ID: Q14563
  ENST ID: ENST00000265362
  CDS Start-End: 316-2631
aagcaccactgcagcagaccttgttaattttttttttttttctttccacacaacagttgtgcctcattatccggtgcctggctcggaatttttttttttttttttctttttggagggtttgaagtttctgtgcttcagtgactgttacagaagaagaggtgttagtgttgccatgaggtcttgattgtctgcatttatgaatgaaactgacctaaatcacctgttacctccagtttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaatatacatgaacttttttcatggcattatgtggatgtttacaatggtgggaaattcagctgagttccaccaattataaattaaatccatgagtaactttcctaataggctttttttcctaataccaccacctaacagagaacacaggtgaatgcagatgttcactttagcagacttaatgtttcctatgagatttcactgtacaggtttgtctttcttctttgcctgagaaataaaaatgtcatttgccatattgccatctaaaggagaaaaactgcatcagcaaagccattgtattgaactaaaagtttaaaatgaactgcatggatttactaagctgatgaatattccaaaacgtggttggattcaaggatatattttgtctaccggccctcatgtttgtatgtacttgaggagtaaaatgagtaaaatgatactgaatgaaatgttctgtggaaatattaaaaaaaaaaaaaaacataagccatccatcatccagaagaaaaatggaatacactgatctactactgatgtcttctttcagctttgatctaaagatgtattttattaaaactataatttaaatgtaccatgaaaaatatgcagtaaaaattagttgttttctaagctagagtaggatttgtcttacaattattgtgctatgtagtttttgttttaaaaattccaatggtgtgctgctttctttggacattttattttcaattctataagagggatagatgacattgttctagaaacacatatacatcattaagagtgaatctctaaaaccaggatataaattatgctttatttctctgagaaaatcaaacaaatggaagctgttcacacctccccttctttaagcattatctaaattaatttttacttgcataatgttcttagaaaaaaaaacagaacatttaagcaggaaaaaaggaagaaacaagttgatttttaagtgcattttactataatgaatcaatgaagggaaaaggaactgcatatttcatgaaaataataagcattgtcttaatatactgttaatagaaaatgtgtcttaattccgtgcttgaatccctgcatgatatttgagactaagatctctcttatgattctaccaagaattatatctgtgtcacttaatttttttaaaagagagagatcaataactattcagagcaacatgttaaaggcaaagtttccaatcatttacatctgtatcaggtgcctcttacctttccttatttaagacaattatttgtacaagaaacacatgactcttttcatatcaatgggagggacttttctacaaagtattttccaggatgcaacccacatttaaacaatgtaaaattctttgtttcctgcaacaacttacaaaataaggtaaaagactaaaattcaagatttgcttccttcattgtcctaagacgattcgttgagaatcactgactttgagatatttaaaactttcagcattatactgtggtttcttttgcactgcactcacctattcaggactcctcccccaggttcctcatcatgcacaaaaatgcaaagaaaacatcttattagtaattaatgaagcaacattgaaattctaactctagctgtctttggattctaattaactcagcatcaatttctcacctcagactacagtgaatttttatttcctatcagctgaaatatttcacagatggaagctcatgtttcagttttaatgactgccttgaataaacaagttgttgccacttgtttcaaacaaaagcctaaaaataatctacattcaattttaggctccattgactaatatggtgttgcttttggaagtactgtatatcctcacatggaagccaaattgttaaattatttgaaggacacaccactgtacagaaagtagtgtttcaaatataaatcgaagaacaaagagtgctccaaaaaataggtcattcttttattttcataaagtatctaaactgtactaacattcagtgttgtgtttcattctaaatttgcagctgaaataaatttatttgcgatagcagaaatatcttattattcatcctcagaaataaaggatttgaagggatagagattatatgataaatttatagaagactttcagaatttgaatgcattttgtttagtgttatgaaatgacaatagaaaaaagtctcgacttcaattaaaagttacacaaacaaacaaatctacaggcatgtctttatataccatcaggtctaagttttcaaagaaaattgtagatataacttgcagataactcattacagtcataatctctgcccatgtgtattgagagggggcagtttgcacgaaaaagaattattggcccatttaataattcagctttaaatagactttgtcatatgcatgaatcatcagagatgaaactgtttgagagactcatgtgaccttacgaaaattacaacagcagtcttaaagtatgaaaaagatgcatcacagcagagacattatggcccagttgatatcaaatgtaaaatgtaaatgcatgtaaatgcacacttcattttatgtattatttagtaatttgcagtggtatgtgtttaatatttttgctacctacacattaggcaaaaaaaagatgtaaataatttgggagaaaaagaggaagaacagtgtaaaataaaactttctataagtactccatttcaatgtgttcaacatcatcctaaaaggcaagattttcccacgcaggtgacaaggtggtttatgtactatttaagggcggaaggtgcgtgcccgttcaataagcatgttttttgccaggtaggaaatatgttccatatctttacttatcattgcatttcagatgggaactagaaaaactggagagaaaaatgtaatgaaactgctgctgtaaattattccttttagcatgtattcacttgctaaatacacatttcttcaaaatatttgaattcagatgtctttactgttccctataacatatggtgttaaggaacataagctcataaaatgttgagaaccagagtcaggttgctacataattagctaacagatttcttcattgtagtcatctgtaaactgggttctatatttatggtgatgatgtgaatttttatgccctttaaattaagtattgttctttttaatgtcatacctaaaaaggaaatgtagggataaatttttataatgtgtcattttcataatcagtttggttttattcaggatccacaaagatgtcagatgactgttattgaaattgcttatcttaaaggtcacagacaagcattttattaatatggagccactagtataatatgttaaaatctttgttttattagctcattttaaaacacaatttccattcaatttaatgaaactgtatcaggtttcatggtttcaaagacagacttaaataggattcaacacccccgtatcgtgtaataacatgttaaactggtctaacaccaaggacatctatacttttaacttgatttgtaataattatttgaagtcaatgttaatgtttgcaaatacatgtttccataaagaagaaaacattatttttcaaaaatctgtaaaatctcattagtttgtttgatctctaaaaattttcttaaactagttaattaaatgaacataatttttcaagttaataaattaagaaaatatctaaatgaaagagagaataaaatcagcatatgtgacagcccatatagtaaggacagtttcgcaatcaacgtaaccaaggaaaacagctttgttatcatttcaaacatgcaggcacacacaggcagaggcaaagctggaaccaaaccaaacaaaaagaagattttgaatattaaaaaactgggcctctagacactttgccttttagaaccagcttcctacacgttcaagtaaattccactgatagatcttgactatctacaatgtgctaggtattatgttaggtgatgaggacactaaagtgaataagacataacccttgttctcaaagagctcacaatgaaattaaggaaacagagcgagatgacttatcatcatctaatccagcaagtctttcctaatcctcccatccctagttcaagctagggaccttctctatgctaaacctgtgccttgtatataccttttattgtcacactaccccaatgtgtgatttatttgtttatgtttccatctccatttctagactgtgagctccttgagggcaggatttgtatctaattgatctctgtccccagtgtctagcatgatgcctggcacaaagagggagcccaataaatcactgttgaaaagaaccaagttacgatatgacaattgccaaatacaagctcacaataagagcggtatggatcaaagaaaaaaaaaaggaggaattaacttgtggagagagatcatggggtgcttcagagaataagtgactttccagctgtgaatcagtcagatatgcctagatgaagaaacaaaatggcaatctgagtagaagaaataaggagaaaggaggagaggtgtgaaaaaaagtcctttttctgagaacaagcattcaaacagataaaacacaggtttcataaagaaaagttaaatgtcccactactatgagtcaaaatggtgcatttgctttttcctgggttttgatttattgccctctgtttgtaccccacattcgcatccttggcacagactgtcatatgtcacacattcagcctcctacacttccaccccacaatctctttaccttccttcttaatgttcacctcatttatctttactcagctaaagtcatagcactagacagtgttcccacaaccgtcttcaaactcatctgtatttcataatctctcctctagttcaaaccagcacaggtcagctgaaactctgaattctacaaataaatatttagaggaagctaacttcatcagacactcccctatgctctcagttcaaacgaaagtttctgttacatttcacctacctacagccttacctcactcagctagcattagactactcagcaatgagttccaacattgccttgctaaaaagcaaggtggctcacaaacaagacttcagcaaagatagcattaaaatgtgaagtctgcatttgttcaaggcataccttagatggagtaattcatggccaagcaatgctgcaggtgtggtcagcacatgtagttgataggcagactcctattattttaaacaaacaaaccaaaaaagttttttaaaaaatgagacccaccttcatcttgaatatgtcaaccccgcaccaccgttgtattaatctgtcatgtttttctcatataacaaaagaatggattttctttcttttaatctaaacactatacttgtatatacaatgtttatttatataggacctaagcaaaagtttttatagatgtgttcatgtcatcacaattcaggtaatgtgaaggctcaacttccgtcttctctctttgtaaatctcactgaagcattagatctcaagtaaatacatttgtaaaatatcca

SEQ ID NO: 179694 - DNA, 553 bp, Homo sapiens
  Payload ID: 15416
  Gene Symbol: SEMA3A
  Gene Name: sema domain, immunoglobulin domain (Ig), short basic domain, secreted, (semaphorin) 3A
  ENST ID: ENST00000420047
  CDS Start-End: 107-553
gttctcccattgtcagccagtctatttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcat

SEQ ID NO: 179695 - DNA, 534 bp, Homo sapiens
  Payload ID: 15416
  Gene Symbol: SEMA3A
  Gene Name: sema domain, immunoglobulin domain (Ig), short basic domain, secreted, (semaphorin) 3A
  ENST ID: ENST00000448879
  CDS Start-End: 423-534
atttatccctaatctggagggcaacctggagctaggtaagaacagaacagccctttgacttcaacgcatggacaaaggacaacaaaggcacactcattctgtctcctgctaccctgtgaaaaggtgccttctgccattattgtaagcttcctgaggcctcctcagccatgtggaactaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaag

SEQ ID NO: 179696 - DNA, 568 bp, Homo sapiens
  Payload ID: 15416
  Gene Symbol: SEMA3A
  Gene Name: sema domain, immunoglobulin domain (Ig), short basic domain, secreted, (semaphorin) 3A
  ENST ID: ENST00000424555
  CDS Start-End: 511-568
gagatgaagcctgatagatccgcccaggtgtaggtgaaatggtagagcctcaggggtaatagattctgtgctctcatgctgaagtttagtgctgtgtcttgactggctctctagcatcagtgtgatgggctgctcctggtacagttacaaagtgaacatgcttcttgctgctcacatttatccctaatctggagggcaacctggagctaggtaagaacagaacagccctttgacttcaacgcatggacaaaggacaacaaaggcaaatatttaaaaaaaccatccatgggacagtctaacataacaaagggaattattcatcaagaagaggccctttagcagggtatttaaagtgcccaggtacttacaataacaagttggactgaacacattgtatctcaggaattaagaatttttcctaaaagaagtttccagattgtttgaacttctctggccgcacaatacaggaaggaagactaaagcagcaaagggacctacagcgtctgcagcatgggctggttaactaggattgtctgtcttttctggggagtattacttacagcaagag

SEQ ID NO: 179697 - DNA, 2550 bp, Homo sapiens
  Payload ID: 15416
  Gene Symbol: SEMA3A
  Gene Name: sema domain, immunoglobulin domain (Ig), short basic domain, secreted, (semaphorin) 3A
  Uniprot ID: Q14563
  ENST ID: ENST00000436949
  CDS Start-End: 165-2480
cacacacacacacacacacacacgcacacatacaatgcacaagttcagcaggattgtataatgagcatgaattgtaaatttttttccagattgtttgaacttctctggccgcacaatacaggaaggaagactaaagcagcaaagggacctacagcgtctgcagcatgggctggttaactaggattgtctgtcttttctggggagtattacttacagcaagagcaaactatcagaatgggaagaacaatgtgccaaggctgaaattatcctacaaagaaatgttggaatccaacaatgtgatcactttcaatggcttggccaacagctccagttatcataccttccttttggatgaggaacggagtaggctgtatgttggagcaaaggatcacatattttcattcgacctggttaatatcaaggattttcaaaagattgtgtggccagtatcttacaccagaagagatgaatgcaagtgggctggaaaagacatcctgaaagaatgtgctaatttcatcaaggtacttaaggcatataatcagactcacttgtacgcctgtggaacgggggcttttcatccaatttgcacctacattgaaattggacatcatcctgaggacaatatttttaagctggagaactcacattttgaaaacggccgtgggaagagtccatatgaccctaagctgctgacagcatcccttttaatagatggagaattatactctggaactgcagctgattttatggggcgagactttgctatcttccgaactcttgggcaccaccacccaatcaggacagagcagcatgattccaggtggctcaatgatccaaagttcattagtgcccacctcatctcagagagtgacaatcctgaagatgacaaagtatactttttcttccgtgaaaatgcaatagatggagaacactctggaaaagctactcacgctagaataggtcagatatgcaagaatgactttggagggcacagaagtctggtgaataaatggacaacattcctcaaagctcgtctgatttgctcagtgccaggtccaaatggcattgacactcattttgatgaactgcaggatgtattcctaatgaactttaaagatcctaaaaatccagttgtatatggagtgtttacgacttccagtaacattttcaagggatcagccgtgtgtatgtatagcatgagtgatgtgagaagggtgttccttggtccatatgcccacagggatggacccaactatcaatgggtgccttatcaaggaagagtcccctatccacggccaggaacttgtcccagcaaaacatttggtggttttgactctacaaaggaccttcctgatgatgttataacctttgcaagaagtcatccagccatgtacaatccagtgtttcctatgaacaatcgcccaatagtgatcaaaacggatgtaaattatcaatttacacaaattgtcgtagaccgagtggatgcagaagatggacagtatgatgttatgtttatcggaacagatgttgggaccgttcttaaagtagtttcaattcctaaggagacttggtatgatttagaagaggttctgctggaagaaatgacagtttttcgggaaccgactgctatttcagcaatggagctttccactaagcagcaacaactatatattggttcaacggctggggttgcccagctccctttacaccggtgtgatatttacgggaaagcgtgtgctgagtgttgcctcgcccgagacccttactgtgcttgggatggttctgcatgttctcgctattttcccactgcaaagagacgcacaagacgacaagatataagaaatggagacccactgactcactgttcagacttacaccatgataatcaccatggccacagccctgaagagagaatcatctatggtgtagagaatagtagcacatttttggaatgcagtccgaagtcgcagagagcgctggtctattggcaattccagaggcgaaatgaagagcgaaaagaagagatcagagtggatgatcatatcatcaggacagatcaaggccttctgctacgtagtctacaacagaaggattcaggcaattacctctgccatgcggtggaacatgggttcatacaaactcttcttaaggtaaccctggaagtcattgacacagagcatttggaagaacttcttcataaagatgatgatggagatggctctaagaccaaagaaatgtccaatagcatgacacctagccagaaggtctggtacagagacttcatgcagctcatcaaccaccccaatctcaacacaatggatgagttctgtgaacaagtttggaaaagggaccgaaaacaacgtcggcaaaggccaggacataccccagggaacagtaacaaatggaagcacttacaagaaaataagaaaggtagaaacaggaggacccacgaatttgagagggcacccaggagtgtctgagctgcattacctctagaaacctcaaacaagtagaaacttgcctagacaataactggaaaaacaaatgcaa

SEQ ID NO: 179698 - DNA, 2292 bp, Homo sapiens
  Payload ID: 15417
  Gene Symbol: SEMA3B
  Gene Name: sema domain, immunoglobulin domain (Ig), short basic domain, secreted, (semaphorin) 3B
  ENST ID: ENST00000611067
  CDS Start-End: 28-2292
gaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccgccccttccccgcagaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtga

SEQ ID NO: 179699 - DNA, 2925 bp, Homo sapiens
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENST ID: ENST00000618865
  CDS Start-End: 243-2492
gggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcc

SEQ ID NO: 179700 - DNA, 934 bp, Homo sapiens
  Payload ID: 15417
  Gene Symbol: SEMA3B
  Gene Name: sema domain, immunoglobulin domain (Ig), short basic domain, secreted, (semaphorin) 3B
  ENST ID: ENST00000621029
  CDS Start-End: 293-934
aaactttacggcacggcgggcggtgcgtggggcggtggctggcctggtgggggcgggggctgcttcttaaaggagccgtcagagggtccccagcggccccagggtgggaaggggccagagtggagagatgctgctgcggaagtcctcggtggagtgtgagaaggcagccagtgttggcctggaagacctctagaacctgagaagaggcagcgatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagcca

SEQ ID NO: 179701 - DNA, 2958 bp, Homo sapiens
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENST ID: ENST00000616701
  CDS Start-End: 236-2485
tctgtgattgtggccaggcggggcaccctcggaggggagggttcggaagtggaatgcgaccccccagcctctttcccctaggggctgtaatctgatccctggggactccccccctagcctcccgccctcgccctcactgctgactcctcttccagatcctggggcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaaccccagtcctcggc

SEQ ID NO: 179702 - DNA, 2738 bp, Homo sapiens
  Payload ID: 15417
  Gene Symbol: SEMA3B
  Gene Name: sema domain, immunoglobulin domain (Ig), short basic domain, secreted, (semaphorin) 3B
  ENST ID: ENST00000611418
  CDS Start-End: 57-1430
ctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggcaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagcc

SEQ ID NO: 179703 - DNA, 1765 bp, Homo sapiens
  Payload ID: 15417
  Gene Symbol: SEMA3B
  Gene Name: sema domain, immunoglobulin domain (Ig), short basic domain, secreted, (semaphorin) 3B
  ENST ID: ENST00000418576
  CDS Start-End: 375-1595
atggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaagaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttatta

SEQ ID NO: 179704 - DNA, 2755 bp, Homo sapiens
  Payload ID: 15417
  Gene Symbol: SEMA3B
  Gene Name: sema domain, immunoglobulin domain (Ig), short basic domain, secreted, (semaphorin) 3B
  Uniprot ID: Q13214
  ENST ID: ENST00000433753
  CDS Start-End: 73-2319
gcagagtccagggcagctcaaggctcctccacacacacacccgctgaaccctgagcaccctgagctgctgagatggggcgggccggggctgccgccgtgatcccgggcctggccctgctctgggcagtggggctggggagtgccgcccccagccccccacgccttcggctctccttccaagagctccaggcctggcatggtctccagactttcagcctggagcgaacctgctgctaccaggccttgctggtggatgaggagcgtggacgcctgtttgtgggtgccgagaaccatgtggcctccctcaacctggacaacatcagcaagcgggccaagaagctggcctggccggcccctgtggaatggcgagaggagtgcaactgggcagggaaggacattggtactgagtgcatgaacttcgtgaagttgctgcatgcctacaaccgcacccatttgctggcctgtggcacgggagccttccacccaacctgtgcctttgtggaagtgggccaccgggcagaggagcccgtcctccggctggacccaggaaggatagaggatggcaaggggaagagtccttatgaccccaggcatcgggctgcctccgtgctggtgggggaggagctatactcaggggtggcagcagacctcatgggacgagactttaccatctttcgcagcctagggcaacgtccaagtctccgaacagagccacacgactcccgctggctcaatgagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaa

SEQ ID NO: 179705 - DNA, 2221 bp, Homo sapiens
  Payload ID: 15417
  Gene Symbol: SEMA3B
  Gene Name: sema domain, immunoglobulin domain (Ig), short basic domain, secreted, (semaphorin) 3B
  ENST ID: ENST00000456560
  CDS Start-End: 542-1762
ctgatcctttggattcggtccgcgcagagcgccaactggacatggtgctagaggttgggtggtcagacactgtgatcccgggtgctgtgcccgcactacgggaaggggaagcagcgcgtgggtctcgcatcaggaggcaaggccaggacccgctgacccatgcctcctgccgcggtcagagcccaagtttgtcaaggtattttggatcccggagagcgagaacccagacgacgacaaaatctacttcttctttcgtgagacggcggtagaggcggcgccggcactgggacgcctgtccgtgtcccgcgttggccagatctgccggaacgacgtgggcggccagcgcagcctggtcaacaagtggacgacgttcctgaaggcgcggctggtgtgctcggtgcccggcgtcgagggcgacacccacttcgatcagctccaggatgtgtttctgttgtcctcgcgggaccaccggaccccgctgctctatgccgtcttctccacgtccagcatcttccagggctctgcggtgtgcgtgtacagcatgaacgacgtgcgccgggccttcttgggaccctttgcacacaaggaggggcccatgcaccagtgggtgtcataccagggtcgcgtcccctacccgcggccaggcatgtgccccagcaagacctttggcaccttcagttccaccaaggacttcccagacgatgtcatccagtttgcgcggaaccaccccctcatgtacaactctgtcctgcccactggggggcgccctcttttcctacaagttggagccaattacaccttcactcaaattgccgcggaccgggttgcagccgctgacggacactatgacgtcctcttcattggcacagacgttggcacggtgctgaaggtgatctcggtccccaagggcagtaggcccagcgcagaggggctgctcctggaggagctgcacgtgtttgaggactcggccgctgtcaccagcatgcaaatttcttccaagaggcaccagctgtacgtagcctcgcggagcgcggtggcccagatcgcgttgcaccgctgcgctgcccacggccgcgtctgcaccgaatgctgtctggcgcgtgacccctactgcgcctgggacggggtcgcgtgcacgcgcttccagcccagtgccaagaggcggttccggcggcaagacgtaaggaatggcgaccccagcacgttgtgctccggagactcgtctcgtcccgcgctgctggaacacaaggtgttcggcgtggagggcagcagcgcctttctggagtgtgagccccgctcgctgcaggcgcgcgtggagtggactttccagcgcgcaggggtgacagcccacacccaggtgctggcagaggagcgcaccgagcgcaccgcccggggactactgctgcgcaggctgcggcgccgggactcgggcgtgtacttgtgcgccgccgtcgagcagggctttacgcaaccgctgcgtcgcctgtcgctgcacgtgttgagtgctacgcaggccgaacgactggcgcgggccgaggaggctgcgcccgccgcgccgccgggccccaaactctggtaccgggactttctgcagctggtggagccgggcggaggtggcagcgcgaactccctgcgcatgtgccgcccgcagcctgcgctgcagtcactgcccctggagtcgcggagaaagggccgtaaccggaggacccacgcccctgagcctcgcgctgagcgggggccgcgcagcgcaacgcactggtgaccagactgtccccacgccgggaaccaagcaggagacgacaggcgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggccgaggaggtgcctggagtgcccaccctgggagacagaccccacctccttgggtagtgagcagtgagcagaaagctgtgaacaggctgggctgctggaggtggggcgaggcaggccgactgtactaaagtaacgcaataaacgcattatcagccaaagctggaatggccccagcagaaaa

SEQ ID NO: 179706 - DNA, 5174 bp, Homo sapiens
  Payload ID: 15418
  Gene Symbol: SEMA3C
  Gene Name: sema domain, immunoglobulin domain (Ig), short basic domain, secreted, (semaphorin) 3C
  Uniprot ID: Q99985
  ENST ID: ENST00000265361
  CDS Start-End: 563-2818
ggactgcgaaaggagcagggttgcggagctagggctccagcctgcggccgcgcattcttgcgtctggccagccgcgagctctaagggtcggccccgcccggtccgcccccgcggctccctgccaggctctcgcgggcgcgctcggggtggggcctcgcggctggcggagatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgcttccattaacaaatgctctgtcttcaatgatcaaattttgagcaaagaaacttgtgctttaccaaggggaattactgaaaaaggtgattactcctgaagtgagttttacacgaactgaaatgagcatgcattttcttgtatgatagtgactagcactagacatgtcatggtcctcatggtgcatataaatatatttaacttaacccagattttatttatatctttattcaccttttcttcaaaatcgatatggtggctgcaaaactagaattgttgcatccctcaattgaatgagggccatatccctgtggtattcctttcctgctttggggctttagaattctaattgtcagtgattttgtatatgaaaacaagttccaaatccacagcttttacgtagtaaaagtcataaatgcatatgacagaatggctatcaaaagaaatagaaaaggaagacagcatttaaagttgtataaaaacatgagttattcataaagagaaaatgatgagtttttatggttccaatgaaatatgttggggtttttttaagattgtaaaaataatcagttactggtatctgtcactgacctttgtttccttattcaggaagataaaaatcagtaacctaccccatgaagatatttggtgggagttatatcagtgaagcagtttggtttatattcttatgttatcaccttccaaacaaaagcacttactttttttggaagttatttattttagactcaaagaatataatctggcactactcagttattactgtttgttctcttattccctagtctgtgtggcaaattaaacaatataagaaggaaaaatttgaagtattagacttctaaataaggtgtgaaatcatcaaaaagaaaaatcaaagtagaaactactaattttttaagaggaatttataacaaatatggctagttttcaacttcagtactcaaattcaatgattcttccttttattaaaaccagtctcagatatcatactgatttttaagtcaacactatatattttatgatcttttcagtgtgatggcaaggtgcttgttatgtctagaaagtaagaaaacaatatgaggagacattctgtctttcaaaaggtaatggtacatacgttcactggtctctaagtgtaaaagtagtaaattttgtgatgaataaaataattatctcctaattgtatgttagaataattttattagaataatttcatactgaaattattttctccaaataaaaattagatggaaaaatgtgaaaaaaattattcatgctctcatatatattttaaaaacactacttttgcttttttatttaccttttaagacattttcatgcttccaggtaaaaacagatattgtaccatgtacctaatccaaatatcatataaacattttatttatagttaataatctatgatgaaggtaattaaagtagattatggcctttttaagtattgcagtctaaaacttcaaaaactaaaatcattgtcaaaattaatatgattattaatcagaatatcagaatatgattcactatttaaactatgataaattatgataatatatgaggaggcctcgctatagcaaaaatagttaaaatgctgacataacaccaaacttcattttttaaaaaatctgttgttccaaatgtgtataattttaaagtaatttctaaagcagtttattataatggtttgcctgcttaaaaggtataattaaacttcttttctcttctacattgacacacagaaatgtgtcaatgtaaagccaaaaccatcttctgtgtttatggccaatctattctcaaagttaaaagtaaaattgtttcagagtcacagttccctttatttcacataagcccaaactgatagacagtaacggtgtttagttttatactatatttgtgctatttaattctttctattttcacaattattaaattgtgtacactttcattacttttaaaaatgtagaaattcttcatgaacataactctgctgaatgtaaaagaaaattttttttcaaaaatgctgttaatgtatactactggtggttgattggttttattttatgtagcttgacaattcagtgacttaatatctattccatttgtattgtacataaaattttctagaaatacacttttttccaaagtgtaagtttgtgaatagattttagcatgatgaaactgtcataatggtgaatgttcaatctgtgtaagaaaacaaactaaatgtagttgtcacactaaaatttaattggatattgatgaaatcattggcctggcaaaataaaacatgttgaattcccca

SEQ ID NO: 179707 - DNA, 1318 bp, Homo sapiens
  Payload ID: 15418
  Gene Symbol: SEMA3C
  Gene Name: sema domain, immunoglobulin domain (Ig), short basic domain, secreted, (semaphorin) 3C
  ENST ID: ENST00000458729
  CDS Start-End: 395-517
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaactaatacttgtgtctgaagataacagtaattttttattcttgtgtcccctactgggcacatcaaagtgctttttggataaaatatgctcaagtaatggatacgtatattaacatataagtatattctgaaaactgacct

SEQ ID NO: 179708 - DNA, 577 bp, Homo sapiens
  Payload ID: 15418
  Gene Symbol: SEMA3C
  Gene Name: sema domain, immunoglobulin domain (Ig), short basic domain, secreted, (semaphorin) 3C
  ENST ID: ENST00000411788
  CDS Start-End: 168-359
tttcactcctcatcactaggtgggatgtaaatcaaattgccctgtagactatcttcgtttcacctgccattgtatcaccagtattctttgcaattggttgtatatgtacttttgggagaaacatataaggtattttcccttggatattaacttgcatatctgaagaaatggcattccggacaatttgcgtgttggttggagtatttatttgttctatctgtgtgaaaggatcttcccagccccaagcaagagtttatttaacatttgatgagcctaccttgtacaatgctgtgtgctacatctgtgggtacaaaaagaagtgtggcgtgaatttggtcctcagcaaccacctactctaaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatc

SEQ ID NO: 179709 - DNA, 785 bp, Homo sapiens
  Payload ID: 15418
  Gene Symbol: SEMA3C
  Gene Name: sema domain, immunoglobulin domain (Ig), short basic domain, secreted, (semaphorin) 3C
  ENST ID: ENST00000427167
  CDS Start-End: 395-586
gatgcggccggggctgcgcggtggtgatgcgagcctgcagggcggcgcgccggggcagccggagccgcgcgccgcggcgctgtaatcggacaccaagagcgctcgcccccggcctccggccactttccattcactccgaggtgcttgattgagcgacgcggagaagagctccgggtgccgcggcactgcagcgctgagattcctttacaaagaaactcagaggaccgggaagaaagaatttcacctttgcgacgtgctagaaaataaggtcgtctgggaaaaggactggagacacaagcgcatccaaccccggtagcaaactgatgacttttccgtgctgatttctttcaacctcggtattttcccttggatattaacttgcatatctgaagaaatggcattccggacaatttgcgtgttggttggagtatttatttgttctatctgtgtgaaaggatcttcccagccccaagcaagagtttatttaacatttgatgagcctaccttgtacaatgctgtgtgctacatctgtgggtacaaaaagaagtgtggcgtgaatttggtcctcagcaaccacctactctaaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgc

SEQ ID NO: 179710 - DNA, 2415 bp, Homo sapiens
  Payload ID: 15418
  Gene Symbol: SEMA3C
  Gene Name: sema domain, immunoglobulin domain (Ig), short basic domain, secreted, (semaphorin) 3C
  Uniprot ID: Q99985
  ENST ID: ENST00000419255
  CDS Start-End: 134-2389
acagttcaggaaacttaaaaggatggcatatggaagttgagtgaaggagaaagagagggaagtagaaaagaggagaaaaatgttaagcaaaaaaggtattttcccttggatattaacttgcatatctgaagaaatggcattccggacaatttgcgtgttggttggagtatttatttgttctatctgtgtgaaaggatcttcccagccccaagcaagagtttatttaacatttgatgaacttcgagaaaccaagacctctgaatacttcagcctttcccaccatcctttagactacaggattttattaatggatgaagatcaggaccggatatatgtgggaagcaaagatcacattctttccctgaatattaacaatataagtcaagaagctttgagtgttttctggccagcatctacaatcaaagttgaagaatgcaaaatggctggcaaagatcccacacacggctgtgggaactttgtccgtgtaattcagactttcaatcgcacacatttgtatgtctgtgggagtggcgctttcagtcctgtctgtacttacttgaacagagggaggagatcagaggaccaagttttcatgattgactccaagtgtgaatctggaaaaggacgctgctctttcaaccccaacgtgaacacggtgtctgttatgatcaatgaggagcttttctctggaatgtatatagatttcatggggacagatgctgctatttttcgaagtttaaccaagaggaatgcggtcagaactgatcaacataattccaaatggctaagtgaacctatgtttgtagatgcacatgtcatcccagatggtactgatccaaatgatgctaaggtgtacttcttcttcaaagaaaaactgactgacaataacaggagcacgaaacagattcattccatgattgctcgaatatgtcctaatgacactggtggactgcgtagccttgtcaacaagtggaccactttcttaaaggcgaggctggtgtgctcggtaacagatgaagacggcccagaaacacactttgatgaattagaggatgtgtttctgctggaaactgataacccgaggacaacactagtgtatggcatttttacaacatcaagctcagttttcaaaggatcagccgtgtgtgtgtatcatttatctgatatacagactgtgtttaatgggccttttgcccacaaagaagggcccaatcatcagctgatttcctatcagggcagaattccatatcctcgccctggaacttgtccaggaggagcatttacacccaatatgcgaaccaccaaggagttcccagatgatgttgtcacttttattcggaaccatcctctcatgtacaattccatctacccaatccacaaaaggcctttgattgttcgtattggcactgactacaagtatacaaagatagctgtggatcgagtgaacgctgctgatgggagataccatgtcctgtttctcggaacagatcggggtactgtgcaaaaagtggttgttcttcctactaacaactctgtcagtggcgagctcattctggaggagctggaagtctttaagaatcatgctcctataacaacaatgaaaatttcatctaaaaagcaacagttgtatgtgagttccaatgaaggggtttcccaggtatctctgcaccgctgccacatctatggtacagcctgtgctgactgctgcctggcgcgggacccttattgcgcctgggatggccattcctgttccagattctacccaactgggaaacggaggagccgaagacaagatgtgagacatggaaacccactgactcaatgcagaggatttaatctaaaagcatacagaaatgcagctgaaattgtccagtatggagtaaaaaataacaccacttttctggagtgtgcccccaagtctccgcaggcatctatcaagtggctgttacagaaagacaaagacaggaggaaagaggttaagctgaatgaacgaataatagccacttcacagggactcctgatccgctctgttcagggttctgaccaaggactttatcactgcattgctacagaaaatagtttcaagcagaccatagccaagatcaacttcaaagttttagattcagaaatggtggctgttgtgacggacaaatggtccccatggacctgggccagctctgtgagggctttacccttccacccgaaggacatcatgggggcattcagccactcagaaatgcagatgattaaccaatattgcaaagacactcggcagcaacatcagcagggagatgaatcacagaaaatgagaggggactatggcaagttaaaggccctcatcaatagtcggaaaagtagaaacaggaggaatcagttgccagagtcataatattttcttatgtgggtcttatgctt

SEQ ID NO: 179711 - DNA, 6265 bp, Homo sapiens
  Payload ID: 15419
  Gene Symbol: SEMA3D
  Gene Name: sema domain, immunoglobulin domain (Ig), short basic domain, secreted, (semaphorin) 3D
  Uniprot ID: O95025
  ENST ID: ENST00000284136
  CDS Start-End: 45-2378
ttagattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaagaatgatgtaggaggacaacgcagcctgataaacaagtggacgacttttcttaaggccagactgatttgctcaattcctggaagtgatggggcagatacttactttgatgagcttcaagatatttatttactccccacaagagatgaaagaaatcctgtagtatatggagtctttactacaaccagctccatcttcaaaggctctgctgtttgtgtgtatagcatggctgacatcagagcagtttttaatggtccatatgctcataaggaaagtgcagaccatcgttgggtgcagtatgatgggagaattccttatccacggcctggtacatgtccaagcaaaacctatgacccactgattaagtccacccgagattttccagatgatgtcatcagtttcataaagcggcactctgtgatgtataagtccgtatacccagttgcaggaggaccaacgttcaagagaatcaatgtggattacagactgacacagatagtggtggatcatgtcattgcagaagatggccagtacgatgtaatgtttcttggaacagacattggaactgtcctcaaagttgtcagcatttcaaaggaaaagtggaatatggaagaggtagtgctggaggagttgcagatattcaagcactcatcaatcatcttgaacatggaattgtctctgaagcagcaacaattgtacattggttcccgagatggattggttcagctctccttgcacagatgcgacacttatgggaaagcttgcgcagactgttgtcttgccagagacccctactgtgcctgggatggaaatgcatgctctcgatatgctcctacttctaaaaggagagctagacgccaagatgtaaaatatggcgacccaatcacccagtgctgggacatcgaagacagcattagtcatgaaactgctgatgaaaaggtgatttttggcattgaatttaactcaacctttctggaatgtatacctaaatcccaacaagcaactattaaatggtatatccagaggtcaggggatgagcatcgagaggagttgaagcccgatgaaagaatcatcaaaacggaatatgggctactgattcgaagtttgcagaagaaggattctgggatgtattactgcaaagcccaggagcacactttcatccacaccatagtgaagctgactttgaatgtcattgagaatgaacagatggaaaatacccagagggcagagcatgaggaggggaaggtcaaggatctattggctgagtcacggttgagatacaaagactacatccaaatccttagcagcccaaacttcagcctcgaccagtactgcgaacagatgtggcacagggagaagcggagacagagaaacaaggggggcccaaagtggaagcacatgcaggaaatgaagaagaaacgaaatcgaagacatcacagagacctggatgagctccctagagctgtagccacgtagttttctacttaatttaaagaaaagaattccttacctataaaaacattgccttctgttttgtatatcccttatagtaattcataaatgcttcccatggagttttgctaaggcacaagacaataatctgaataagacaatatgtgatgaatataagaaagggcaaaaaattcatttgaaccagttttccaagaacaaatcttgcacaagcaaagtataagaattatcctaaaaatagggggtttacagttgtaaatgttttatgttttgagttttggaatttattgtcatgtaaatagttgagctaagcaagccccgaatttgatagtgtataaggtgctttattccctcgaatgtccattaagcatggaatttaccatgcagttgtgctatgttcttatgaacagatatatcattcctattgagaaccagctaccttgtggtagggaataagaggtcagacacaaattaagacaactcccattatcaacaggaactttctcagtgagccattcactcctggagaatggtataggaatttggagaggtgcattatttctttctggccactggggttaaatttagtgtactacaacattgatttactgaagggcactaatgtttcccccaggatttctattgactagtcaggagtaacaggttcacagagagaagttggtgcttagttatgtgttttttagagtatatactaagctctacagggacagaatgcttaataaatactttaataagatatgggaaaatattttaataaaacaaggaaaacataatgatgtataatgcatcctgatgggaaggcatgcagatgggatttgttagaagacagaaggaaagacagccataaattctggctttggggaaaactcatatccccatgaaaaggaagaacaatcacaaataaagtgagagtaatgtaatggagctcttttcactagggtataagtagctgccaatttgtaattcatctgttaaaaaaaatctagattataacaaactgctagcaaaatctgaggaaacataaattcttctgaagaatcataggaagagtagacattttatttataaccaatgatatttcagtatatattttctctcttttaaaaaatatttatcatactctgtatattatttctttttactgcctttattctctcctgtatattggattttgtgattatatttgagtgaataggagaaaacaatatataacacacagagaattaagaaaatgacatttctggggagtggggatatatatttgttgaataacagaacgagtgtaaaattttaacaacggaaagggttaaattaactctttgacatcttcactcaaccttttctcattgctgagttaatctgttgtaattgtagtattgtttttgtaatttaacaataaataagcctgctacatgtaaaaagaaccaaactcacaatattaacataaacatctttcatattttgttagtactttcaaatgttttcaatttgactttccctctgaatatgcatggtgtgtttcctgtctgtttaagcagaactcacctttccttcttgtaacacagaacccttagccttcttctgttttgccttttcacgccctttatagtgtgaaatgaaaaattagtcacttcctcacatggaaggcagcttttcagaaaataacagacattgctcgtttctcatgcattctacatatcttgaaagaaaagtctgtgagaaaaccctgtgattagagggcaacttaatgcaagatctgtggctctatgttgagagcattctctctctgttatttttattttatttgcattgcttacctatctcaaagtagtcaaactgatatatgagattgagtactcccttttgatattatactgatgaatatttgtaggtgtttcactataaggaacagctaaggaataattttaataaaagtgaaccagaacaaatcactcatttaaaaagtaattcagaagaacagtgtggcatgatcagacttctaattgaatagcgtaacaacagtgtttgtaattatagatttgcttggacaaaatattccaggaactcatagcgagctcaaagcaattaagtgggaacatttttaatttaaaaaaaatttccaaatatttgtgggtccgacagtaatgatcaaaatatgaatgactttggaaaatttacatgaagctcaagtgttaggattgacttatgaaaataaattttatttctatccaaatttgaatgtccaaaccattttttagttacttctttctaatcctagttattcagacaaaatttggaaacttattttatgaccacatctaatattctggctgctttggatacaatactcttgatttatgataattagttaaaatatattaaaaatattattagtaaaataaaatttcacacaataaaaaacaacatagagtacacatatttatatgtatttttaaagataaagaatatctaaaatgtgtttttttcttagctttttagttgtctagaacatttagagaaagagtatgaatatattaaatccacaaacacactatatacttcctcaccactgactattttatcaaatttgccttaaaataatgaaaaagaaaagtatagttaatggtttcaaatatgctaagaaattgactctgcggaggggatcttaaaatgcctgtttactcatgttttcgtatttttcttgtctctaatacttttgtctttgtctgccttgtgtgttcttttctgaatttcatttcagcaatttatgctgctaaatagaatcccgcatgtctgcattcatttacattcaacttattgtaaattttgagattttatttagaaatgaattgtctaattaatttatgtagagtccttttttccaaagagctcaaaacactacatccacattattgacttttggaaaccaaccaaattacttaagaaatggaaaagtagtcacagagaaatttagtaatttgcaaaagccacaacagtagtggaagaattaaaattcataaagtctcatcattctgttggctaaaataatgctctttacaatatgctggctacaaaatggtcttactcttgaattttgcttttggttcatattttggttcttcatattctagtatgttttgttcctgctgaattttacagactcagctaaacaataagttattagtagtcacttgttttcattatcataattgaatttccaagaacaacttgatatcattcagctgtccaaaaaataataagagcattcattaaatactgattttcttaaacttaaatgttgtatttcatatttatttatataatacaaatggaaatcaaaactgaaatagcctccctttagaatgtcacatttttcttagaaaacattttggaattggttaaccttattgggaatggataatttagaaacaaaccaaaaaaaaaaaaagatatttgaagtgtttttataggagatgtatttttatcatagtaaatgatcacaattttaaataattcatcttacaagtcaggtaaaataaaatcgattcccagattccatacattaggagtgcaaagacaggatcatacacatgacttatacctctcatttaaatattttatagtataaagtatttatggaaagggtttgagatagatgatttttgggaaagggcaaaatgtgtcagatgccctagttaatcatgtaatttaattctggtattgtgagtggttagcaatcaattttgaatttataattctgctattttaaaagaaatgtagtcttgtagtatgaaataattaaaaattgttaaatgtatattttggttgtattataataaaatgcaaacatgactgttctatgattataaaaa

SEQ ID NO: 179712 - DNA, 1605 bp, Homo sapiens
  Payload ID: 15419
  Gene Symbol: SEMA3D
  Gene Name: sema domain, immunoglobulin domain (Ig), short basic domain, secreted, (semaphorin) 3D
  ENST ID: ENST00000444867
  CDS Start-End: 351-1235
agcttcccggctctgccagggctgccggcggctccgcttgctcagccagggctgcggctcagaggaacgcgcgccggtgccccgggttgccgcgccgctggacctcagcctgcatcccgttcccctctccctgaaaaggcaccaggaaaagagagagggagagaagagttcacagcaggtctttacacttggactagaactgtaacatctgctgtcctggttgccaggcttttgaacatacactgttggttctcctggatcttcaccttaccaactgcagatcttgggactcatcagcctcaataattatattaaattaacaccatttgaaagagaacattgttttcatcatgaatgctaataaagatgaaagacttaaagccagaagccaagattttcacctttttcctgctttgatgatgctaagcatgaccatgttgtttcttccagtcactggcactttgaagcaaaatattccaagactcaagctaacctacaaagacttgctgctttcaaatagctgtattccctttttgggttcatcagaaggactggattttcaaactcttctcttagatgaggaaagaggcaggctgctcttgggagccaaagaccacatctttctactcagtctggttgacttaaacaaaaattttaagaagatttattggcctgctgcaaaggaacgggtggaattatgtaaattagctgggaaagatgccaatacagaatgtgcaaatttcatcagagtacttcagccctataacaaaactcacatatatgtgtgtggaactggagcatttcatccaatatgtgggtatattgatcttggagtctacaaggaggatattatattcaaactagacacacataatttggagtctggcagactgaaatgtcctttcgatcctcagcagccttttgcttcagtaatgacagatgagtacctctactctggaacagcttctgatttccttggcaaagatactgcattcactcgatcccttgggcctactcatgaccaccactacatcagaactgacatttcagagcactactggctcaatggagcaaaatttattggaactttcttcataccagacacctacaatccagatgatgataaaatatatttcttctttcgtgaatcatctcaagaaggcagtacctccgataaaaccatcctttctcgagttggaagagtttgtaaggagaatttgtgctttgaagattgatcttatttctgaacatagtcaaagtaatttggagctgtatttggagaaagttgcataaatgatttgaacaatgcaaattttggtcaagagatatcaatgaagagagacacaataaataaactgacttaaaagataattttactgggcaatattgatcaatgagagcctgaggcgaataagtgccttcatccacagaatatcttttaaacttaatatgtttataattatacatggtagagcacatttcctaatgaattatttttagtagtgttcctactttccagtcaaactacttactctatttttccaataaattgtttaaccttgaaggatttctaaagtccttgtcaagctctacagttctttcatt

SEQ ID NO: 179713 - DNA, 6476 bp, Homo sapiens
  Payload ID: 15420
  Gene Symbol: SEMA3E
  Gene Name: sema domain, immunoglobulin domain (Ig), short basic domain, secreted, (semaphorin) 3E
  Uniprot ID: O15041
  ENST ID: ENST00000307792
  CDS Start-End: 469-2796
cagtttggcaagtcagtgcaagaggctgacttctgagaggcttccaggagcccgaagagaggacctccacgggagaagggagtgcgtgtgctcggttttgtttttttctctcttttttttttttttttctgaatgaacagctttgcccaagtgactgaaaaatacagcttcttcctgaatctaccggcgtagttgctgaagagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatttctgtaatacaggaatgactatgaaggtgttataataaattattctacatactcatttgactggataaactttacataaaattaactaattttttaaataaatgcattgcttaatggtttctcattatgtttatcaaaaaacaactgtagctgttattttcagtacttggctgcttttctgtgaaaattattattttacttttggaagacaagattattagaatattgaagaaaaattggagacttataatcatggtaaatataaaactaaatatgttttaatatttctgaatttttcttttccatcacaatgtaagatatgcagaatacaagatactttggcattctcatgtgaactttctgtactctttaaggattattttattagtgttgtttaagccatgagtgttaagtagcaggtgtgttgtgagtgctgtaacccatgaaaggaaaaatgtcattctgaggcttgtgcccttcgtaaaatattcattaaagtacattcacactatttttgctttataacacagtctttaattttcactcactgtggaaataaaaactaaggtaacttctcagaaagatatcaaatctcagaaagaatgtcaaatcagatgaagttatagttaggattctaactactgtaaaagatttttgcttccctcttgtggtaaaaaaaattatattctcacacatttcttttttctctacagacggatatctgtttaggaaagatttgaaagcagattatcagtaggtacatggatacatcaagttcatttgcagaaacaaataactgaaataaaaaacatgttaatccttgtatcatactttaatatgaaagtattgtttatagataatttatctcacaagtcaaaaatgaagattttgcagcactgaaaatctattaaagctccaaattttaagtttctaaataatcttcgctgaaatctaaaatatactataacaaccgtgttttatttgtgaaaaaaatattaaagtgatttgctctcaaatatcaaattttcttctctcttttatattaagagacagaaaattgtttcatgagttcacttaactactgagatattcagagcatttttacctctctcttaaatgttataaaaaacaattgtatttttaagaatgtttatttatcaaagtctttccttcttctattaaatatttagcaattacctttctaaaatatgaaattttgtaagatgttttcacctaaataaaaattgaaagcaagtggattacacaggagaaccattatgaacatttatttagatattaatcttaaacagtgtttatttcagttttcaaagttagcttataggttatacatttaagttaaagtgctcataatcacttgcaatttcattgtaaaatgaacaaatacataaatattttaagaaaaatttaagtttattcagataagtcaccatgcttcaaaagatctaagaaatgcaaatatactgaaaattgacatcctctgaaaattccacttgctatttacccaagaatccactggaggtcattactgccattaaataataactgaaaagactatgtagtgaaatgtatttttaaaaactatattcagtaaaagcctgctcaatttggagaaatagaaccacaaacacagatcacaggggccttacaaagtttatgtctgaacaaataagtcaattaagtacactttattgaaaattgccttccattaacacacaagaaagaaagcaggattttctcctgtatctgaattttaaaattaaaaaggcagataagacataaatagttatcattttaattgcaataacacagacaagtagttaatgatgataacaatggtgtaacttgtaaactaaatatttggtaactgaagcaataggcagaggaaaatagcttttctatgacacaagtcataagaagtccatatactgaagagcgtttgattaaaataaagtgactattaaccagaaaagaaacattttacataaaatgctaaaatttattataggaaaataaatcaaacccaaagaaagtttattcaatgctaatttgaaagaaaattgataagaaaactttgagggcccaagtccacaatttggtgagaccactaaattttacatataattatacacacacatatgtacatatatatgtatataatcttgcttcccgcctgtttatggcagtactgaagagaaatgggaaagaagagggagggagagagaaagacgaagggagagagaaagcagtttccaaggatatgtttcatgtcccaccattttctcagtttctccctctctctcccaacacacacacacacacacccctcacatactataaaataaatcttcactgccctatcaaaatacaaataaatcaatctatgctgttctgtccttcttgagaatctaaaacataccacaaaaatacatccccagtcttttgttctgtctgaggttagaattaattcaaattcagaatctgttgtgagaaatgcccaggctttaaaaattaaaaatggatggatcttctctgaactcagggagggcacatacttagatacctacaagacttggaggaattaagagttcacccttcatctcaccaaattttccccatttttctctttcttgtagaaggagagaaaccatgctctctagcaacattgagcaaaaatcataaccactcatctaatttctaagaggcacctccatcgagggccggtctcctgcttctttagacctcttctatctttgttacaggagaggacctgtggatagacttagttttgacataaaacaatgcccattcacctcctccttcagcacaacgtcacccattgggcaagagatccagatttgttaacaaaaaagattttacttcgtgattccacgtctataattctatattgctaattttttcttttgtgtgaattactgaatatttcagagcaaagctatcaacttggagaaacagggattaaaaataaggataaacactaataagagctctagaaaaaagggaacagaaagtctgcctgtttagtaagtggcaattccatacatattttagagttttttctatctaaaattagttaaatacttagaatgtttgtaatgagtgttcgatatttgctataggttttagggttttgtaaatcttcatagtaattataaacatttgtaaaatttgtaaaatactataagtcattttgagtgttggtgttaagcatgaaacaaacagcagctgttgtccttaaaaatgaattgacctggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctacttgggaggctgaggcaggagaatggcgtgaacccgggaagcggagcttgcagtgagccgagattgcgccactgcagtccgcagtccggcctgggcgacagagcgagactccgtctc

SEQ ID NO: 179714 - DNA, 2414 bp, Homo sapiens
  Payload ID: 15420
  Gene Symbol: SEMA3E
  Gene Name: sema domain, immunoglobulin domain (Ig), short basic domain, secreted, (semaphorin) 3E
  Uniprot ID: O15041
  ENST ID: ENST00000427262
  CDS Start-End: 166-2313
aaactaaacagtgtcctataggcagctatcagctcagcatgtgttgtttacttggaaagtgaaagaaagtctcccactttgccttcccttagatgaacagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaagaaccaaaatttgtaggttcatacatgattcctgacaatgaagacagagatgacaacaaagtatatttcttttttactgagaaggcactggaggcagaaaacaatgctcacgcaatttacaccagggtcgggcgactctgtgtgaatgatgtaggagggcagagaatactggtgaataagtggagcactttcctaaaagcgagactcgtttgctcagtaccaggaatgaatggaattgacacatattttgatgaattagaggacgtttttttgctacctaccagagatcataagaatccagtgatatttggactctttaacactaccagtaatatttttcgagggcatgctatatgtgtctatcacatgtctagcattcgggcagccttcaacggaccatatgcacataaggaaggacctgaataccactggtcagtctatgaaggaaaagtcccttatccaaggcctggttcttgtgccagcaaagtaaatggagggagatacggaaccaccaaggactatcctgatgatgccatccgatttgcaagaagtcatccactaatgtaccaggccataaaacctgcccataaaaaaccaatattggtaaaaacagatggaaaatataacctgaaacaaatagcagtagatcgagtggaagctgaggatggccaatatgacgtcttgtttattgggacagataatggaattgtgctgaaagtaatcacaatttacaaccaagaaatggaatcaatggaagaagtaattctagaagaacttcagatattcaaggatccagttcctattatttctatggagatttcttcaaagcggcaacagctgtatattggatctgcttctgctgtggctcaagtcagattccatcactgtgacatgtatggaagtgcttgtgctgactgctgcctggctcgagacccttactgtgcctgggatggcatatcctgctcccggtattacccaacaggcacacatgcaaaaaggcgtttccggagacaagatgttcgacatggaaatgcagctcagcagtgctttggacaacagtttgttggggatgctttggataagactgaagaacatctggcttatggcatagagaacaacagtactttgctggaatgtaccccacgatctttacaagcgaaagttatctggtttgtacagaaaggacgtgagacaagaaaagaggaggtgaagacagatgacagagtggttaagatggaccttggtttactcttcctaaggttacacaaatcagatgctgggacctatttttgccagacagtagagcatagctttgtccatacggtccgtaaaatcaccttggaggtagtggaagaggagaaagtcgaggatatgtttaacaaggacgatgaggaggacaggcatcacaggatgccttgtcctgctcagagtagcatctcgcagggagcaaaaccatggtacaaggaattcttgcagctgatcggttatagcaacttccagagagtggaagaatactgcgagaaagtatggtgcacagatagaaagaggaaaaagcttaaaatgtcaccctccaagtggaagtatgccaaccctcaggaaaagaagctccgttccaaacctgagcattaccgcctgcccaggcacacgctggactcctgatggggtgagactatctactgtcttttgaagaatttatatttggaaagtaaaaaagtaaaaaaataaatcatccaacttctttgcattacttaaaagagatt

SEQ ID NO: 179715 - DNA, 626 bp, Homo sapiens
  Payload ID: 15420
  Gene Symbol: SEMA3E
  Gene Name: sema domain, immunoglobulin domain (Ig), short basic domain, secreted, (semaphorin) 3E
  ENST ID: ENST00000442159
  CDS Start-End: 137-626
gttcaaactggacgaacctacaattatcaaaatctcctcttagcattaagaaggcagtcaggactcagcagagctcttgaatctgaacagaacatcaatatttcatagcccttttggatttcttgatctccatacaatgctgctggatgaatatcaagagaggctcttcgtgggaggcagggaccttgtatattccctcagcttggagagaatcagtgacggctataaagagatacactggccgagtacagctctaaaaatggaagaatgcataatgaagggaaaagatgcgggtgaatgtgcaaattatgttcgggttttgcatcactataacaggacacaccttctgacctgtggtactggagcttttgatccagtttgtgccttcatcagagttggatatcatttggaggatcctctgtttcacctggaatcacccagatctgagagaggaaggggcagatgtccttttgaccccagctcctccttcatctccactttaattggtagtgaattgtttgctggactctacagtgactactggagcagagacgctgcgatcttccgcagcatggggcgactggcccatatccgcactgagcatgacgatgagcgtctgttgaaag

SEQ ID NO: 179716 - DNA, 571 bp, Homo sapiens
  Payload ID: 15420
  Gene Symbol: SEMA3E
  Gene Name: sema domain, immunoglobulin domain (Ig), short basic domain, secreted, (semaphorin) 3E
  ENST ID: ENST00000453333
  CDS Start-End: 269-388
gagcgctctagacaggacatggctctgaagactcactctttggaatgtcctcttgctcccggcttataaacaactgtcccgaggaaagaaaggttttacatagccaaatacagcctgacaaatggcacttcggaactgtgctttctgatgacaacgcgttcgatttctgacaaagcctctcgcacgctgcccctggagggaagtcctaagtaaaactcagaccctccttaaagtgaggagcgagggcttggacggtgaacacggcagcatggcatccgcggggcacattatcaccttgctcctgtggggttacttactggagctttggacaggaggtcatacagctgatactacccacccccggttacgcctgtcacataaagaatgaagagtgtttcttgtcagaggtgggatctcatctgggccttcacaacttgaatgaagaaaagacatggaggaggaaactgcaggctcaagtaaaaagagctcttgaatctgaacagaacatcaatatttcatagcccttttggatttcttgatctccatacaatgctgctggatgaatatcaag

SEQ ID NO: 179717 - DNA, 3802 bp, Homo sapiens
  Payload ID: 15421
  Gene Symbol: SEMA3F
  Gene Name: sema domain, immunoglobulin domain (Ig), short basic domain, secreted, (semaphorin) 3F
  Uniprot ID: Q13275
  ENST ID: ENST00000002829
  CDS Start-End: 485-2842
agcgcagcgcaggacctgggtacgccgcgaggaaccgtgcagcccagcgcggccgcccggcccgggtccagcagccaggagagcgcagcgcttcgaagccgagtgcgcgccaccgcccgcgccccgcgctggggaatgcgccctcggcgcgccggccagggggcgcccgcagcccaccccaggggaggcggccccgagcgcccctgagccttcccatggcccgggctggggcccgggccctcggctgctgacgcgcccgaagcccgcggaaccggttaagccgcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggccacaccatggacccagactcaggcggtcagaggccgcggcagcagagccacggatggtgccctccgcccgatgcccacagccccacgccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagttggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactaga

SEQ ID NO: 179718 - DNA, 3212 bp, Homo sapiens
  Payload ID: 15421
  Gene Symbol: SEMA3F
  Gene Name: sema domain, immunoglobulin domain (Ig), short basic domain, secreted, (semaphorin) 3F
  ENST ID: ENST00000413852
  CDS Start-End: 193-2253
gagcgagcgaacgaaccgcggcggtccggagagccccgagcgcagcgcaggacctgggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagttggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggactag

SEQ ID NO: 179719 - DNA, 936 bp, Homo sapiens
  Payload ID: 15421
  Gene Symbol: SEMA3F
  Gene Name: sema domain, immunoglobulin domain (Ig), short basic domain, secreted, (semaphorin) 3F
  ENST ID: ENST00000414301
  CDS Start-End: 144-936
cccgcgcggctctgagcgccccgtcccgccggcggccgcgagaccagagcgagcgaacgaaccgcggcggtccggagagccccgagcgcagcgcaggacctggagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgca

SEQ ID NO: 179720 - DNA, 1693 bp, Homo sapiens
  Payload ID: 15421
  Gene Symbol: SEMA3F
  Gene Name: sema domain, immunoglobulin domain (Ig), short basic domain, secreted, (semaphorin) 3F
  ENST ID: ENST00000450338
  CDS Start-End: 555-1693
agcgccccgtcccgccggcggccgcgagaccagagcgagcgaacgaaccgcggcggtccggagagccccgagcgcagcgcaggacctgggtacgccgcgaggaaccgtgcagcccagcgcggccgcccggcccgggtccagcagccaggagagcgcagcgcttcgaagccgagtgcgcgccaccgcccgcgccccgcgctggggaatgcgccctcggcgcgccggccagggggcgcccgcagcccaccccaggggaggcggccccgagcgcccctgagccttcccatggcccgggctggggcccgggccctcggctgctgacgcgcccgaagcccgcggaaccggttaagccgcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcac

SEQ ID NO: 179721 - DNA, 757 bp, Homo sapiens
  Payload ID: 15421
  Gene Symbol: SEMA3F
  Gene Name: sema domain, immunoglobulin domain (Ig), short basic domain, secreted, (semaphorin) 3F
  ENST ID: ENST00000426511
  CDS Start-End: 482-757
gcggccgcggcgccgatcccggctgaggcgcagcggcgagaggtcgcgggcagggccatggccccggggggccgctagcgcggaccggcccaacgggagccgctccgtgccgccgccgccgcccgggcgcccaggccccgccgctgcggaagaggtgagtgcagcgggaaccgggagggagcgggcaggcggccgggccaccccgcgacccctctgggacccgcggcactgcaactccgcagaagtgtccggggagcgggtctcgtcgagccggggggctgcccgcggacataggggcaacaaggctggggtgggattcttacctgtcctggaggcccggaccccttacctacggggcggcgtatggatgtgtggatgatgtggcctgcggggtcacccatgtgcaaagcaactttttcctgcaaggttctgggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattgta

SEQ ID NO: 179722 - DNA, 3541 bp, Homo sapiens
  Payload ID: 15421
  Gene Symbol: SEMA3F
  Gene Name: sema domain, immunoglobulin domain (Ig), short basic domain, secreted, (semaphorin) 3F
  Uniprot ID: Q13275
  ENST ID: ENST00000434342
  CDS Start-End: 319-2583
ctgactggtgctccctctcttccatcttgggctgtctgcatgtgtctcattcccccactctctcctgtgcctcccctctaccgtaataatcaggtccaggtttctctgtactgggagaagacctgtggctggagcaggcagggatgcaccctatctgttccccattcctccaggtgggagggagaaggagtaacccactttattggccacagatgcaggggagaaaggagaaagcatgctgggagctggaaagagccctaagatcacctggtttctagagagtggagcctgcttcctgggccctaggcccctcccacaatgcttgtcgccggtcttcttctctgggcttccctactgaccggggcctggccatccttccccacccaggaccacctcccggccacgccccgggtccggctctcattcaaagagctgaaggccacaggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatcaatgaggagctctatgctggtgtgtacatcgattttatgggcactgatgcagccatcttccgcacacttggaaagcagacagccatgcgcacggatcagtacaactcccggtggctgaacgacccgtcgttcatccatgctgagctcattcctgacagtgcggagcgcaatgatgataagctttacttcttcttccgtgagcggtcggcagaggcgccgcagagccccgcggtgtacgcccgcatcgggcgcatttgcctgaacgatgacggtggtcactgttgcctggtcaacaagtggagcacattcctgaaggcgcggctcgtctgctctgtcccgggcgaggatggcattgagactcactttgatgagctccaggacgtgtttgtccagcagacccaggacgtgaggaaccctgtcatttacgctgtctttacctcctctggctccgtgttccgaggctctgccgtgtgtgtctactccatggctgatattcgcatggtcttcaacgggccctttgcccacaaagaggggcccaactaccagtggatgcccttctcagggaagatgccctacccacggccgggcacgtgccctggtggaaccttcacgccatctatgaagtccaccaaggattatcctgatgaggtgatcaacttcatgcgcagccacccactcatgtaccaggccgtgtaccctctgcagcggcggcccctggtagtccgcacaggtgctccctaccgccttaccactattgccgtggaccaggtggatgcagccgacgggcgctatgaggtgcttttcctgggcacagaccgcgggacagtgcagaaggtcattgtgctgcccaaggatgaccaggagttggaggagctcatgctggaggaggtggaggtcttcaaggatccagcacccgtcaagaccatgaccatctcttctaagaggcaacaactctacgtggcgtcagccgtgggtgtcacacacctgagcctgcaccgctgccaggcgtatggggctgcctgtgctgactgctgccttgcccgggacccttactgtgcctgggatggccaggcctgctcccgctatacagcatcctccaagaggcggagccgccggcaggacgtccggcacggaaaccccatcaggcagtgccgtgggttcaactccaatgccaacaagaatgccgtggagtctgtgcagtatggcgtggccggcagcgcagccttccttgagtgccagccccgctcgccccaagccactgttaagtggctgttccagcgagatcctggtgaccggcgccgagagattcgtgcagaggaccgcttcctgcgcacagagcagggcttgttgctccgtgcactgcagctcagcgatcgtggcctctactcctgcacagccactgagaacaactttaagcacgtcgtcacacgagtgcagctgcatgtactgggccgggacgccgtccatgctgccctcttcccaccactgtccatgagcgccccgccacccccaggcgcaggccccccaacgcctccttaccaggagttagcccagctgctggcccagccagaagtgggcctcatccaccagtactgccagggttactggcgccatgtgccccccagccccagggaggctccaggggcaccccggtctcctgagccccaggaccagaaaaagccccggaaccgccggcaccaccctccggacacatgaggccagctgcctgtgcctgccatgggccagcctagcccttgtcccttttaatataaaagatatatatatatatatatatatataaaatatctatattctatacacaccctgcccctgcaaagacagtatttattggtgggttgaatatagcctgcctcagtggcagcatcctccaaaacttagacccatgctggtcagagacggcagaaaacagagcctgcctaaccaggcccagccagttggtggggccaggccaggaccacacagtccccagactcagctggaagtctacctgctggacagcctccgccaagatctacaggacaaagggagggagcaagccctactcggatggggcacggactgtccaccttttctgatgtgtgttgtcagcctgtgctgtggcatagacatggatgcgaggaccactttggagactggggtggcctcaagagcacacagagaagggaagaaggggccatcacaggatgccagcccctgcctgggttgggggcactcagccacgaccagccccttcctgggtatttattctctatttattggggataggagaagaggcatcctgcctgggtgggacagcctcttcagccccttctcccctccccgcctggccagggcagggccaccccactctacctccttagctttccctgtgccactttgactcagaggctgggagcatagcagaggggccaggcccaggcagagctgacgggaggccccagctctgaggggagggggtccgtggtagaggcctggggccggtagaggctccccagggctcccttatgtccaccacttcaggggatgggtgtggatgtaattagctctggggggcagttgggtagatgggtgggggctcctggtggccttctgctgcccaggccacagccgcctttgggttccatcttgctaataaacactggctctgggacta

SEQ ID NO: 179723 - DNA, 442 bp, Homo sapiens
  Payload ID: 15421
  Gene Symbol: SEMA3F
  Gene Name: sema domain, immunoglobulin domain (Ig), short basic domain, secreted, (semaphorin) 3F
  ENST ID: ENST00000420831
  CDS Start-End: 1-442
ggcaccgcccacttcttcaacttcctgctcaacacaaccgactaccgaatcttgctcaaggacgaggaccacgaccgcatgtacgtgggcagcaaggactacgtgctgtccctggacctgcacgacatcaaccgcgagcccctcattatacactgggcagcctccccacagcgcatcgaggaatgcgtgctctcaggcaaggatgtcaacccttccctgtggccccagggcgagtgtgggaacttcgtcaggctcatccagccctggaaccgaacacacctgtatgtgtgcgggacaggtgcctacaaccccatgtgcacctatgtgaaccgcggacgccgcgcccaggattacatcttctacctggagcctgagcgactcgagtcagggaagggcaagtgtccgtacgatcccaagctggacacagcatcggccctcatca

SEQ ID NO: 179724 - DNA, 4899 bp, Homo sapiens
  Payload ID: 15422
  Gene Symbol: SEMA3G
  Gene Name: sema domain, immunoglobulin domain (Ig), short basic domain, secreted, (semaphorin) 3G
  Uniprot ID: Q9NS98
  ENST ID: ENST00000231721
  CDS Start-End: 1-2349
atggccccctcggcctgggccatttgctggctgctagggggcctcctgctccatgggggtagctctggccccagccccggccccagtgtgccccgcctgcggctctcctaccgagacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccctcgccctggcgtgtgccccagcaagatgaccgcacagccaggacggccttttggcagcaccaaggactacccagatgaggtgctgcagtttgcccgagcccaccccctcatgttctggcctgtgcggcctcgacatggccgccctgtccttgtcaagacccacctggcccagcagctacaccagatcgtggtggaccgcgtggaggcagaggatgggacctacgatgtcattttcctggggactgactcagggtctgtgctcaaagtcatcgctctccaggcagggggctcagctgaacctgaggaagtggttctggaggagctccaggtgtttaaggtgccaacacctatcaccgaaatggagatctctgtcaaaaggcaaatgctatacgtgggctctcggctgggtgtggcccagctgcggctgcaccaatgtgagacttacggcactgcctgtgcagagtgctgcctggcccgggacccatactgtgcctgggatggtgcctcctgtacccactaccgccccagccttggcaagcgccggttccgccggcaggacatccggcacggcaaccctgccctgcagtgcctgggccagagccaggaagaagaggcagtgggacttgtggcagccaccatggtctacggcacggagcacaatagcaccttcctggagtgcctgcccaagtctccccaggctgctgtgcgctggctcttgcagaggccaggggatgaggggcctgaccaggtgaagacggacgagcgagtcttgcacacggagcgggggctgctgttccgcaggcttagccgtttcgatgcgggcacctacacctgcaccactctggagcatggcttctcccagactgtggtccgcctggctctggtggtgattgtggcctcacagctggacaacctgttccctccggagccaaagccagaggagcccccagcccggggaggcctggcttccaccccacccaaggcctggtacaaggacatcctgcagctcattggcttcgccaacctgccccgggtggatgagtactgtgagcgcgtgtggtgcaggggcaccacggaatgctcaggctgcttccggagccggagccggggcaagcaggccaggggcaagagctgggcagggctggagctaggcaagaagatgaagagccgggtgcatgccgagcacaatcggacgccccgggaggtggaggccacgtagaagggggcagaggaggggtggtcaggatgggctggggggcccactagcagcccccagcatctcccacccacccagctagggcagaggggtcaggatgtctgtttgcctcttagagacaggtgtctctgcccccacaccgctactggggtctaatggaggggctgggttcttgaagcctgttccctgcccttctctgtgctcttagacccagctggagccagcaccctctggctgctggcagccccaagggatctgccatttgttctcagagatggcctggcttccgcaacacatttccgggtgtgcccagaggcaagagggttgggtggttctttcccagcctacagaacaatggccattctgagtgaccctcagagtgggtgtgtgggtgcgtctagggggtatcccggtagggggcctgcagggagccagagggtggaaatggcctctaagctagcaccccgtaagaagagcctacctgaccgacttggggagggaacacagaggtgttgggaaggtggagcaacaatgcacctcccctcctgtcgcgccgtgatatcttggtggctccctgccactgcccaccgcctcttctccatctgagaatcacggagaggtgtagataatctagaggcatagactgctagagcccccagggatctggggtggtcagggctcaggcttcactttgtaaaccaggtgggggcatctcacagcctgacttcccttccccaggccagggttgctgggatgcctgcccctcctgagaggaccccctccccattgtcaggctctccatgtccacgagcggggaggggtgggttctggggcattgttgtcccttgtgtctgtggactagagatagggtgggggagctggggaagggtgcaggcgggaagagtgggctgtctttcccagggtgatgcaagcatgccgcagccctggaggctgggaatgtggaggctctgtgagccctgcagccctcagaatcagggccagggatgcagaagattgagaggatatggagatggatagagggcaggagacccttaggatagattgtgggacccaggcaggaacaggtgtccacaagaactcaggatggcatcagttagctcagaagccacctggaagacccagtgtttccatctctggaatctctgttttatgctaaatggatttaggaagactgtttttcttttaagggggaaacaaggtagagaaaaggacgaagaagtgtaagtcccgctgattctcgggggtaaggctcggatggcaaggacgcgttctgcctgggcatgtaggggaggtgtttttgccatcaccagtttctcaggctggggagcacagaggggaggaggaggactaaatgaaaagttgttcccagcctgcacatgaacacattcatgacacacaaaactggctggaaggagataagagcactgggtttgagattccctccattaaaacaaccaagacaaagaaaggaggggaaaaaaagataaaaagcaagccagggttccctgccctattgaaactcaaacccagactgccttgggttttatctttcccttacccctggcacctccagagaactgggacctgaaatagtccctccgttctcccctttgaccatgtaataaatgaaccagaagcactgagattaacctatcaacgccctgagaagccttccagcctgcggtgctgtctgctgggaggtcagctggtcaaggcagaggaggagaggaggaaaggatgggggctgaagagcagaagggaggggagacagaggggattaaagaggggaggagagagtgcagagctccaggaaagggtatcagagctgcagccagctctgccctctaccctagggaggccagaaagacacaaacagccctccgggcctttacgctggactctggcttggcaggctccaggcagggtcctctgggaagttactctagaaaacgaagggaggaggagcacaagatcctcagcaacgaacacctgcacttagaaaaagtggacagcttctgccaaccacaccctacccatggtactgtatgctattaactcctggaaacgccccgtaaatgcgagttgtttttgtatttgtgtgttgagatgggccttgtggtttctctgtactcagagcacatttcttgtaattactattgttatttttattgtcatgactgcccctgagctctggtgagaaaagctgaatttacaaggaaagggatgaagttaatatttgcatcacataattatatcattactgtgtatctgtgtattgtactaaatggactgatgctgcgcacatgagctgaaaatgaagagccctcccatccattccatgagaaagaaggtcaccctgagtgacttctgtttcatgatttcccaaacaggttttagagctggaaaaggacttaaagaaagagactgggtggtgctttctagaaaggaggaagatgggtatcaggggaaggaaggagttagagggctttgtacaaagccgagattgctcattaaatgaggaacatcctggcc

SEQ ID NO: 179725 - DNA, 616 bp, Homo sapiens
  Payload ID: 15422
  Gene Symbol: SEMA3G
  Gene Name: sema domain, immunoglobulin domain (Ig), short basic domain, secreted, (semaphorin) 3G
  ENST ID: ENST00000475739
  CDS Start-End: 59-616
agcgggaccagagggcggctctgcaggcaggcggcagcggtgccctcagttccccagcatggccccctcggcctgggccatttgctggctgctagggggcctcctgctccatgggggtagctctggccccagccccggccccagtgtgccccgcctgcggctctcctaccgaggagccatggtccgaaagccttccagcaccatgtggatggaaacattttccagatacctcctgtctgccaaccgctctgccatctttctgggcccccagggctccctgaacctccaggccatgtacctagatgagtaccgagaccgcctctttctgggtggcctggacgccctctactctctgcggctggaccaggcatggccagatccccgggaggtcctgtggccaccgcagccaggacagagggaggagtgtgttcgaaagggaagagatcctttgacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccggggg

SEQ ID NO: 179726 - DNA, 848 bp, Homo sapiens
  Payload ID: 15422
  Gene Symbol: SEMA3G
  Gene Name: sema domain, immunoglobulin domain (Ig), short basic domain, secreted, (semaphorin) 3G
  ENST ID: ENST00000465657
  CDS Start-End: 1-299
gtagctctggccccagccccggccccagtgtgccccgcctgcggctctcctaccgagacagagtgcgccaacttcgtgcgggtgctacagcctcacaaccggacccacctgctagcctgtggcactggggccttccagcccacctgtgccctcatcacagttggccaccgtggggagcatgtgctccacctggagcctggcagtgtggaaagtggccgggggcggtgccctcacgagcccagccgtccctttgccagcaccttcatagacggggagctgtacacgggtctcactgctgacttcctggggcgagaggccatgatcttccgaagtggaggtcctcggccagctctgcgttccgactctgaccagagtctcttgcacgacccccggtttgtgatggccgcccggatccctgagaactctgaccaggacaatgacaaggtgtacttcttcttctcggagacggtcccctcgcccgatggtggctcgaaccatgtcactgtcagccgcgtgggccgcgtctgcgtgaatgatgctgggggccagcgggtgctggtgaacaaatggagcactttcctcaaggccaggctggtctgctcggtgcccggccctggtggtgccgagacccactttgaccagctagaggatgtgttcctgctgtggcccaaggccgggaagagcctcgaggtgtacgcgctgttcagcaccgtcagtgccgtgttccagggcttcgccgtctgtgtgtaccacatggcagacatctgggaggttttcaacgggccctttgcccaccgagatgggcctcagcaccagtgggggccctatgggggcaaggtgcccttccc

SEQ ID NO: 179727 - DNA, 3137 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENST ID: ENST00000355014
  CDS Start-End: 105-2390
gggctgaggcactgagagaccggaaagcctggcattccagagggagggaaacgcagcggcatccccaggctccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 179728 - DNA, 3249 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENST ID: ENST00000368282
  CDS Start-End: 209-2494
aggatgatgaaagtgagaccgtcttagggcccttccagatagggaaccttctctgccccaatgccccacccctgccaccaatacacacgcttctgctgcctggggctctcctattggtcctcggggggatgtggtaagaactgctcacccagaaagtgcccgggtgcctgtttccccagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatgat

SEQ ID NO: 179729 - DNA, 2981 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENST ID: ENST00000368284
  CDS Start-End: 346-2235
agctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 179730 - DNA, 3300 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  Uniprot ID: Q9H3S1
  ENST ID: ENST00000368285
  CDS Start-End: 268-2553
ccaggatctgtcacaactcgagaggtggaaattccggtttccctggcctagagctcccagtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctta

SEQ ID NO: 179731 - DNA, 3135 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENST ID: ENST00000368286
  CDS Start-End: 218-2389
agtgctggctttggcatgatgggcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatgggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctacgcagtcttcacctcccagtggcaggttggcgggaccaggagctctgcggtttgtgccttctctctcttggacattgaacgtgtctttaaggggaaatacaaagagttgaacaaagaaacttcacgctggactacttataggggccctgagaccaacccccggccaggcagttgctcagtgggcccctcctctgataaggccctgaccttcatgaaggaccatttcctgatggatgagcaagtggtggggacgcccctgctggtgaaatctggcgtggagtatacacggcttgcagtggagacagcccagggccttgatgggcacagccatcttgtcatgtacctgggaaccaccacagggtcgctccacaaggctgtggtaagtggggacagcagtgctcatctggtggaagagattcagctgttccctgaccctgaacctgttcgcaacctgcagctggcccccacccagggtgcagtgtttgtaggcttctcaggaggtgtctggagggtgccccgagccaactgtagtgtctatgagagctgtgtggactgtgtccttgcccgggacccccactgtgcctgggaccctgagtcccgaacctgttgcctcctgtctgcccccaacctgaactcctggaagcaggacatggagcgggggaacccagagtgggcatgtgccagtggccccatgagcaggagccttcggcctcagagccgcccgcaaatcattaaagaagtcctggctgtccccaactccatcctggagctcccctgcccccacctgtcagccttggcctcttattattggagtcatggcccagcagcagtcccagaagcctcttccactgtctacaatggctccctcttgctgatagtgcaggatggagttgggggtctctaccagtgctgggcaactgagaatggcttttcataccctgtgatctcctactgggtggacagccaggaccagaccctggccctggatcctgaactggcaggcatcccccgggagcatgtgaaggtcccgttgaccagggtcagtggtggggccgccctggctgcccagcagtcctactggccccactttgtcactgtcactgtcctctttgccttagtgctttcaggagccctcatcatcctcgtggcctccccattgagagcactccgggctcggggcaaggttcagggctgtgagaccctgcgccctggggagaaggccccgttaagcagagagcaacacctccagtctcccaaggaatgcaggacctctgccagtgatgtggacgctgacaacaactgcctaggcactgaggtagcttaaactctaggcacaggccggggctgcggtgcaggcacctggccatgctggctgggcggcccaagcacagccctgactaggatgacagcagcacaaaagaccacctttctcccctgagaggagcttctgctactctgcatcactgatgacactcagcagggtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggctt

SEQ ID NO: 179732 - DNA, 897 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENST ID: ENST00000438830
  CDS Start-End: 188-897
gcacctggagggccgcactcccgttccagccaggctgagccttctgtcccctgcctctggggcctgggaaccccccttcttctttctcctgaatggcacccccgccctagaatccagacaccgagtttcccactgtggctggttcaagggtatgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgaggaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaa

SEQ ID NO: 179733 - DNA, 975 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENST ID: ENST00000414683
  CDS Start-End: 315-975
cccctgaacccaggtggtgacatgtgcacggtggtgcctgctgaaggtgggcaagggagctgagcagggaccgggggctactgtacctccttttcacctcctcccgcatctggagcccctcctcctccacatgtgcgaatccaggagccacagaaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccaca

SEQ ID NO: 179734 - DNA, 1057 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENST ID: ENST00000435124
  CDS Start-End: 95-1057
gtccggtgcagactctgctggaagtcttggacgcctgggttagggtctccacttctgggctggggagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatgataccgtggccagccagtgacagaaaaaagagtgaatgtgcctttaagaagaagagcaatgagacacagtgtttcaacttcatccgtgtcctggtttcttacaatgtcacccatctctacacctgcggcaccttcgccttcagccctgcttgtaccttcattgaacttcaagattcctacctgttgcccatctcggaggacaaggtcatggagggaaaaggccaaagcccctttgaccccgctcacaagcatacggctgtcttggtggatgggatgctctattctggtactatgaacaacttcctgggcagtgagcccatcctgatgcgcacactgggatcccagcctgtcctcaagaccgacaacttcctccgctggctgcatcatgacgcctcctttgtggcagccatcccttcgacccaggtcgtctacttcttcttcgaggagacagccagcgagtttgacttctttgagaggctccacacatcgcgggtggctagagtctgcaagaatgacgtgggcggcgaaaagctgctgcagaagaagtggaccaccttcctgaaggcccagctgctctgcacccagccggggcagctgcccttcaacgtcatccgccacgcggtcctgctccccgccgattctcccacagctccccacatctac

SEQ ID NO: 179735 - DNA, 531 bp, Homo sapiens
  Payload ID: 15423
  Gene Symbol: SEMA4A
  Gene Name: sema domain, immunoglobulin domain (Ig), transmembrane domain (TM) and short cytoplasmic domain, (semaphorin) 4A
  ENST ID: ENST00000633494
  CDS Start-End: 232-531
agactctgctggaagtcttggacgcctgggttagggtctccacttctgggctggggcaagagaagaaaccactgctaggctggttatactggctgtgacatgatggagaggcaggggaatcgctgaaatgacctagaagggcctcttaaactttctggttggaccgagcagaggagggagagagaggtgtgtctcttgtgagagctccctggtgacagtctgtggctgagcatggccctcccagccctgggcctggacccctggagcctcctgggccttttcctcttccaactgcttcagctgctgctgccgacgacgaccgcggggggaggcgggcaggggcccatgcccagggtcagatactatgcaggggatgaacgtagggcacttagcttcttccaccagaagggcctccaggattttgacactctgctcctgagtggtgatggaaatactctctacgtgggggctcgagaagccattctggccttggatatccaggatccaggggtccccaggctaaagaacatg

SEQ ID NO: 179736 - DNA, 3781 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000332496
  CDS Start-End: 241-2754
ctccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctct

SEQ ID NO: 179737 - DNA, 3807 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000411539
  CDS Start-End: 261-2774
cgccctccgccgcttgcgggtgagctctgcccaagccgaggctgcggggccggcgccggcgggaggactgcggtgccccgcggaggggctgagtttgccagggcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctcttcctct

SEQ ID NO: 179738 - DNA, 541 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559300
  CDS Start-End: 240-395
gcatttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacaggtgagcccacacctggaagggagctgagctgcaggagggatggagggtggtggacttccatccaggccagaggcgggaggtgggagcagatacagccagcgcgactgtcaaaactacatcaagatcctcctgccgctcagcggcagtcac

SEQ ID NO: 179739 - DNA, 559 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559322
  CDS Start-End: 219-559
gttaaacggcatcttccttggatggtctcaggatcacagccttctctaaagaagtattcctctccaaagagctgcaggccttcaacagccttattaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgc

SEQ ID NO: 179740 - DNA, 2804 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000560089
  CDS Start-End: 159-350
gcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctgggggtatgtaaaaacactccacaggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgt

SEQ ID NO: 179741 - DNA, 585 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559792
  CDS Start-End: 221-585
aacatgtactgatgctgcagctgagctgctgcccagcccctggggagaagacaccagcagcatgcccagccagggcagggtggagagctgcagctgcaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagctt

SEQ ID NO: 179742 - DNA, 533 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000558895
  CDS Start-End: 261-533
gagatccgtggcaacccgtctgtgcatccccgctacccacctaggcatacctgttcctgcccactctctgggatcagcatcagaaccaagagcaaggctctgtctgggagtaagagtggcagccaccaggtgacctgaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctcttt

SEQ ID NO: 179743 - DNA, 1697 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559074
  CDS Start-End: 1-1384
tgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaa

SEQ ID NO: 179744 - DNA, 758 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559983
  CDS Start-End: 1-758
ccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggtgagcaggccaacgaggaatcctggcagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtgg

SEQ ID NO: 179745 - DNA, 582 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000561085
  CDS Start-End: 238-582
atttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagt

SEQ ID NO: 179746 - DNA, 850 bp, Homo sapiens
  Payload ID: 15424
  Gene Symbol: SEMA4B
  Gene Name: sema domain, immunoglobulin domain (Ig), transmembrane domain (TM) and short cytoplasmic domain, (semaphorin) 4B
  ENST ID: ENST00000559247
  CDS Start-End: 1-362
tgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccagaattctctctggccctcaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaaga

SEQ ID NO: 179747 - DNA, 3545 bp, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  Uniprot ID: Q9C0C4
  ENST ID: ENST00000305476
  CDS Start-End: 134-2635
gcgagcgcgggcaggcggcgacgcgggggcaggggtggacggcggtcagagccgaacgcgagggcggcgcccggggactggagctgcgcgcaataggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatgaagacagagtacctggccttttggctcaacgaacctcactttgtaggctctgcctatgtacctgagagtgtgggcagcttcacgggggacgacgacaaggtctacttcttcttcagggagcgggcagtggagtccgactgctatgccgagcaggtggtggctcgtgtggcccgtgtctgcaagggcgatatggggggcgcacggaccctgcagaggaagtggaccacgttcctgaaggcgcggctggcatgctctgccccgaactggcagctctacttcaaccagctgcaggcgatgcacaccctgcaggacacctcctggcacaacaccaccttctttggggtttttcaagcacagtggggtgacatgtacctgtcggccatctgtgagtaccagttggaagagatccagcgggtgtttgagggcccctataaggagtaccatgaggaagcccagaagtgggaccgctacactgaccctgtacccagccctcggcctggctcgtgcattaacaactggcatcggcgccacggctacaccagctccctggagctacccgacaacatcctcaacttcgtcaagaagcacccgctgatggaggagcaggtggggcctcggtggagccgccccctgctcgtgaagaagggcaccaacttcacccacctggtggccgaccgggttacaggacttgatggagccacctatacagtgctgttcattggcacaggagacggctggctgctcaaggctgtgagcctggggccctgggttcacctgattgaggagctgcagctgtttgaccaggagcccatgagaagcctggtgctatctcagagcaagaagctgctctttgccggctcccgctctcagctggtgcagctgcccgtggccgactgcatgaagtatcgctcctgtgcagactgtgtcctcgcccgggacccctattgcgcctggagcgtcaacaccagccgctgtgtggccgtgggtggccactctggatctctactgatccagcatgtgatgacctcggacacttcaggcatctgcaacctccgtggcagtaagaaagtcaggcccactcccaaaaacatcacggtggtggcgggcacagacctggtgctgccctgccacctctcctccaacttggcccatgcccgctggacctttgggggccgggacctgcctgcggaacagcccgggtccttcctctacgatgcccggctccaggccctggttgtgatggctgcccagccccgccatgccggggcctaccactgcttttcagaggagcagggggcgcggctggctgctgaaggctaccttgtggctgtcgtggcaggcccgtcggtgaccttggaggcccgggcccccctggaaaacctggggctggtgtggctggcggtggtggccctgggggctgtgtgcctggtgctgctgctgctggtgctgtcattgcgccggcggctgcgggaagagctggagaaaggggccaaggctactgagaggaccttggtgtaccccctggagctgcccaaggagcccaccagtccccccttccggccctgtcctgaaccagatgagaaactttgggatcctgtcggttactactattcagatggctcccttaagatagtacctgggcatgcccggtgccagcccggtggggggcccccttcgccacctccaggcatcccaggccagcctctgccttctccaactcggcttcacctggggggtgggcggaactcaaatgccaatggttacgtgcgcttacaactaggaggggaggaccggggagggctcgggcaccccctgcctgagctcgcggatgaactgagacgcaaactgcagcaacgccagccactgcccgactccaaccccgaggagtcatcagtatgaggggaacccccaccgcgtcggcgggaagcgtgggaggtgtagctcctacttttgcacaggcaccagctacctcagggacatggcacgggcacctgctctgtctgggacagatactgcccagcacccacccggccatgaggacctgctctgctcagcacgggcactgccacttggtgtggctcaccagggcaccagcctcgcagaaggcatcttcctcctctctgtgaatcacagacacgcgggaccccagccgccaaaacttttcaaggcagaagtttcaagatgtgtgtttgtctgtatttgcacatgtgtttgtgtgtgtgtgtatgtgtgtgtgcacgcgcgtgcgcgcttgtggcatagccttcctgtttctgtcaagtcttcccttggcctgggtcctcctggtgagtcattggagctatgaaggggaaggggtcgtatcactttgtctctcctacccccactgccccgagtgtcgggcagcgatgtacatatggaggtggggtggacagggtgctgtgccccttcagagggagtgcagggcttggggtgggcctagtcctgctcctagggctgtgaatgttttcagggtggggggagggagatggagcctcctgtgtgtttggggggaagggtgggtggggcctcccacttggccccggggttcagtggtattttatacttgccttcttcctgtacagggctgggaaaggctgtgtgaggggagagaagggagagggtgggcctgctgtggacaatggcatactctcttccagccctaggaggagggctcctaacagtgtaacttattgtgtccccgcgtatttatttgttgtaaatatttgagtatttttatattgacaaataaaatggagaaaatgaaacgattgctctgatggggctaaga

SEQ ID NO: 179748 - DNA, 839 bp, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  ENST ID: ENST00000449330
  CDS Start-End: 421-839
tagggctcatgccacttgttaatcagccttccagtggcacgaggagtcattttctggggataggcgctttgcccaaagcgtgagaagcaggagcaggccctttctgttgattgaagggtcttcctggctggtgaagccctttccagacttgagggcagggaccagtggtcctcggggcctagaaagaggcagaattgggggccaaacggcagacccctctggtccgccccaaaagacgcctcggttcccccagcgtgcctcccctggatactcgcctcgacgtggctcgcccgcggtcgttcctgcaactgcacggtcgggagtccctctccccagcccagcccgcccggagtcttcgggggacacttcagaaagatcggcaggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgt

SEQ ID NO: 179749 - DNA, 817 bp, Homo sapiens
  Payload ID: 15425
  Gene Symbol: SEMA4C
  Gene Name: sema domain, immunoglobulin domain (Ig), transmembrane domain (TM) and short cytoplasmic domain, (semaphorin) 4C
  ENST ID: ENST00000442264
  CDS Start-End: 214-817
ccctcttgggcaacaaaggggcctcgggaagctgggccccttcgctcccggcccttctcacactcctgccctgctgatgtggaacggggtttggggttctgcagggctattgtctgcgctggggaaggggacaggccgggaccgggacctccgctcgcagccggccgcaccagcaggacagctggcctgaagctcagagccggggcgtgcgccatggccccacactgggctgtctggctgctggcagcaaggctgtggggcctgggcattggggctgaggtgtggtggaaccttgtgccgcgtaagacagtgtcttctggggagctggccacggtagtacggcggttctcccagaccggcatccaggacttcctgacactgacgctgacggagcccactgggcttctgtacgtgggcgcccgagaggccctgtttgccttcagcatggaggccctggagctgcaaggagcgatctcctgggaggcccccgtggagaagaagactgagtgtatccagaaagggaagaacaaccagaccgagtgcttcaacttcatccgcttcctgcagccctacaatgcctcccacctgtacgtctgtggcacctacgccttccagcccaagtgcacctacgtcaacatgctcaccttcactttggagcatggagagtttgaagatgggaagggcaagtgtccctatgacccagctaagggccatgctggccttcttgtggatggtgagctgtactcggccacactcaacaacttcctgggcacggaacccattatcctgcgtaacatggggccccaccactccatga

SEQ ID NO: 179750 - DNA, 4258 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000339861
  CDS Start-End: 427-2643
ccccgccaccccctccccggcccggccgcctcccgccgctgccgccgccgccgccgccgccattcctggcgcccgaactcgcccggccgggagccgccgcgggcaggacgcgcgctgcagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattgttca

SEQ ID NO: 179751 - DNA, 4503 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000356444
  CDS Start-End: 448-3036
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatcctt

SEQ ID NO: 179752 - DNA, 4382 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000422704
  CDS Start-End: 481-3069
agcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcagactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtg

SEQ ID NO: 179753 - DNA, 907 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000420681
  CDS Start-End: 469-907
agagcccttgaaacccctgcagtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctgg

SEQ ID NO: 179754 - DNA, 4275 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000420987
  CDS Start-End: 448-2664
actctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatggaatgagtctcatgagtgttttgttctacctgctttcaagtctctaattattaaagctgtatctctgaagactgtgtcactgtgtgtgtgaacttgtcctaaagctactcagcctttaatcttacacacacgtctcttcttgtctgttgaatgacagttttcatgtctatcataaaaccaaagcctctgttaaaagtcaagccgcacccctctggtgatcctagcaaatactgagtgtcttcccagcagtgtgacaatgacctgttttgcatcccctctttctggagctggacaaattctctaccagcctttgtgtgggatcagcatacatcgcctgctaattccttcaggatccatcacaacaggtgtcctgaagatgctggagacaccctggttgtctccacacgttccccctccgcaccccaagtcgagaggcccagctgcctgtgaggtgtgtgcttgcccatccagccaaggatgccagtcttgctcacggaaccatcacatactcataacctgaagttttcctgtaaaatatccatcagctcactgtggttcttgctttgggtgtggcttcaaccactacaaactgatgagtgaaatgctatgggctttaggcttatattcttggtgctgttttctgtctcttctcctgaagtctggatttcaagcactttcacacttaacaaaataattacatacttgaagttttcgtaatgtggagtgttctactgggaaatggagttatgaggatgaatttctgagtctttctttgctctgctggaaaaaataaaaatagagttgtacattg

SEQ ID NO: 179755 - DNA, 2895 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000429836
  CDS Start-End: 692-2338
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaata

SEQ ID NO: 179756 - DNA, 1837 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000420101
  CDS Start-End: 665-1036
agcccagagaaaaacaacagaggtttgcggcagaagtggccaatgtcgggcccagagtccatgctcaaggctggaagcccatcctggatgtgctgcactcggcagtcctagtgtaattctgcagggcctggcccctgccagggtctgagctctccagcctgtggcatctactcccctccaagcccaccccagtgtctcaattggagagacaggccctcatggtccccactctggcccagccccctctgcacacagctggccgagctctgggcctctccatgctgtggccctggtgatggcagagccttgggatgtctctgtccatgtggtcacaggacatgtgtgtggcagcagggccatggtggggtgggatgctgttccaaggcccagaaccattctgtaagaaaccagcacagcgctgcaagaaagggggtcctaggggacacaggccacacaggtgtgctttgaaaaatggcaattaaggtcaaagagcaggaagtccacaggacgggccaaggccaaggctcccgctggccatggggaagccacctccagggcagtcccagggactgaattggaagttgtcccaagtcacttcaggtccaactgggacagcagaggtaacccccctgcaccctcatggggcagcttctttgggtcctaaatgtggactcagaggtggaaacggtctgtgtccccaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttcttgacgatgg

SEQ ID NO: 179757 - DNA, 4824 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000438547
  CDS Start-End: 767-3355
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttga

SEQ ID NO: 179758 - DNA, 433 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000420670
  CDS Start-End: 91-93
tttggtcgcggaggccgcggaccctgtgcactggacccggcgccgcgcactcagacagactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatg

SEQ ID NO: 179759 - DNA, 3594 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000455551
  CDS Start-End: 585-2801
ctgcgcgcccgccccgcgcactccgtccccgcgccggcctcagcgctctcgcgcgccgcagcatcccagccgccgctgccgccgccgggcctccccgccaccccctccccggcccggccgcctcccgccgctgccgccgccgccgccgccgccattcctggcgcccgaactcgcccggccgggagccgccgcgggcaggacgcgcgctgcagactctgctaacaccagatagtggaaagaaaccatgtgctgaaatgtttgacgacactgatggtttgcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggcgggacagtggagaagcctggaacccaagtgggcctgtgacaggaactaagacttaaaaaattaggtgcttacctgggacagtaagttctgtctggcacaagcaggtaaccaggatggctaacaggctttgatagctgctcgtgaactaaaacagcagggtgtgtgcaggttcctcctctacggtcaggcagcaggctctgaaggctgatcctacaccgtcccagtgactccccttgacagagtgcccccaccccctaatagccaacagggttagcatggccagcacagatcgctgcttttattgatgcaaatcaagcctgctgcttctcctccctgcagacttagccaaggaactccaagatgcatgactgggacaagaaaaggtgagactccacatggaaatgccttgccctaaaccttgaatgactgtgagatgcgatctgggagtgcatctgtcaagtctttgtgttttcttcactaacctcagaatactgggctctattttatcaagcgctgcagtttatgcctctgtcccgtcaatgctcagcttctgcaacaggacaccaaacttgatgcagaaagccaaataggtcaattatgcaaatctcctggtgccatattaaatttctt

SEQ ID NO: 179760 - DNA, 602 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000433650
  CDS Start-End: 376-602
ggtagctggaggagcgggaagcactgactcctgaagaccctggcttcgctttcctgtgtccgttgggctgtccacttctaagactctctttgtcccccgctgccttccgtattcctcagcagatggacccggcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcact

SEQ ID NO: 179761 - DNA, 5684 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  Uniprot ID: Q92854
  ENST ID: ENST00000450295
  CDS Start-End: 778-3366
attacgtggctcctgtgttaatagaatcatggagggatcagcgtcggctcctgagcgtctgcagtcctgcacgtggctctggttttgcgattctgattctcttgatctaattgttggtgctgctactgcaccccacgatccctgtcttgagactgatctcccacactgcaaaggagtgacagccatgctatggaaccttgccacaccacggtggacaccgttctgtttggctgaaaaccagccatccaaaaataaaggaagatgaacagctctttagtgcttgtaattatgccatatgtgtttctgctttttccttctttgcctcatgaagatgaattttaaaggatacatatctggagctaatagacaattagatagtacttttttggttcacagactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaagggcaacaggtttgtctatgctggctctaactcgggcgtggtccaggccccgctggccttctgtgggaagcacggcacctgcgaggactgtgtgctggcgcgggacccctactgcgcctggagcccgcccacagcgacctgcgtggctctgcaccagaccgagagccccagcaggggtttgattcaggagatgagcggcgatgcttctgtgtgcccggataaaagtaaaggaagttaccggcagcattttttcaagcacggtggcacagcggaactgaaatgctcccaaaaatccaacctggcccgggtcttttggaagttccagaatggcgtgttgaaggccgagagccccaagtacggtcttatgggcagaaaaaacttgctcatcttcaacttgtcagaaggagacagtggggtgtaccagtgcctgtcagaggagagggttaagaacaaaacggtcttccaagtggtcgccaagcacgtcctggaagtgaaggtggttccaaagcccgtagtggcccccaccttgtcagttgttcagacagaaggtagtaggattgccaccaaagtgttggtggcatccacccaagggtcttctcccccaaccccagccgtgcaggccacctcctccggggccatcacccttcctcccaagcctgcgcccaccggcacatcctgcgaaccaaagatcgtcatcaacacggtcccccagctccactcggagaaaaccatgtatcttaagtccagcgacaaccgcctcctcatgtccctcttcctcttcttctttgttctcttcctctgcctctttttctacaactgctataagggatacctgcccagacagtgcttgaaattccgctcggccctactaattgggaagaagaagcccaagtcagatttctgtgaccgtgagcagagcctgaaggagacgttagtagagccagggagcttctcccagcagaatggggagcaccccaagccagccctggacaccggctatgagaccgagcaagacaccatcaccagcaaagtccccacggatagggaggactcacagaggatcgacgacctttctgccagggacaagccctttgacgtcaagtgtgagctgaagttcgctgactcagacgcagatggagactgaggccggctgtgcatccccgctggtgcctcggctgcgacgtgtccaggcgtggagagttttgtgtttctcctgttcagtatccgagtctcgtgcagtgctgcgtaggttagcccgcatcgtgcagacaacctcagtcctcttgtctattttctcttgggttgagcctgtgacttggtttctctttgtccttttggaaaaatgacaagcattgcatcccagtcttgtgttccgaagtcagtcggagtacttgaagaaggcccacgggcggcacggagttcctgagccctttctgtagtgggggaaaggtggctggacctctgttggctgagaagagcatcccttcagcttcccctccccgtagcagccactaaaagattatttaattccagattggaaatgacattttagtttatcagattggtaacttatcgcctgttgtccagattggcacgaaccttttcttccacttaattatttttttaggattttgctttgattgtgtttatgtcatgggtcatttttttttagttacagaagcagttgtgttaatatttagaagaagatgtatatcttccagattttgttatatatttggcataaaatacggcttacgttgcttaagattctcagggataaacttccttttgctaaatgcattctttctgcttttagaaatgtagacataaacactccccggagcccactcaccttttttctttttctttttttttttttaactttattccttgagggaagcattgtttttggagagattttctttctgtacttcgttttacttttctttttttttaacttttactctctcgaagaagaggaccttcccacatccacgaggtgggttttgagcaagggaaggtagcctggatgagctgagtggagccaggctggcccagagctgagatgggagtgcggtacaatctggagcccacagctgtcggtcagaacctcctgtgagacagatggaaccttcacaagggcgcctttggttctctgaacatctcctttctcttcttgcttcaattgcttacccactgcctgcccagactttctatccagcctcactgagctgcccactactggaagggaactgggcctcggtggccggggccgcgagctgtgaccacagcaccctcaagcatacggcgctgttcctgccactgtcctgaagatgtgaatgggtggtacgatttcaacactggttaatttcacactccatctccccgctttgtaaatacccatcgggaagagactttttttccatggtgaagagcaataaactctggatgtttgtgcgcgtgtgtggacagtcttatcttccagcatgataggatttgaccattttggtgtaaacatttgtgttttataagatttaccttgtttttatttttctactttgaattgtatacatttggaaagtacccaaataaatgagaagcttctatccttgatttggggaagacattccttagcggaggctgtgcagcctcccgcccctgcatggcccaggcgggacagctgggctcgctcttttctgtccgtttcctgctgtgttttgccctctctggcctgtgacgtgctcctggcgacttcttcctcagtgccctctcttttctgtcctctctgtctcacagcctcgtctcctaagcccctccctcctcctggctcctcttccctgtcctgtctgggccatgtgggggacaggaggctttcctctccctggaccccctggccagcctcgggtgcggggcccgacagcagctcgagggtctccttgctgccgcccttcctgagtgaccaggcacagcacgtgcacgccctggggaacttctacctcttctgccaggccacaggtgagttgggccctctctgtcccctgtgccctgtccatctgtctcctcccacaggtggggggcgggcgggggcatcctccacatccctccacatgttcctttaccttccttatctgtcctggctgcgtccctcgggttgagccgtttcacgctttcattgtgggtccatcccgagggaaactgtagacagtgtgaagccacttctagtgtacaggggtcaaccagtgttttctgtaaagggctagatatttaggccttgtgggctgcaggctgtgtcacagccactaagctctgctgttgtattgtaaaaccagccatagtcaatacacaacgagtggtcagggctgtgtgccagtaaaactttatttataaaaatgcacggtgggccagatttgccccaaaggccccagtttcccaacctgtggtatataggattgcttctccctt

SEQ ID NO: 179762 - DNA, 563 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000418828
  CDS Start-End: 386-563
agtcaggacagacgtcccaggcgagcagaggccctgcgtgaggatggggcggcggggccagatggtgtcctgagtatccatcctccctggtggctgaggacacgctgaccagcgtggggtcaggagcatggcccctggaaagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaagg

SEQ ID NO: 179763 - DNA, 826 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000540475
  CDS Start-End: 629-826
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcc

SEQ ID NO: 179764 - DNA, 2710 bp, Homo sapiens
  Payload ID: 15426
  Gene Symbol: SEMA4D
  Gene Name: sema domain, immunoglobulin domain (Ig), transmembrane domain (TM) and short cytoplasmic domain, (semaphorin) 4D
  ENST ID: ENST00000537934
  CDS Start-End: 767-2413
ggcaacccgctcgggtccccttccacactgtggaagctttgttctttcgctcttgctactgctagctctttgggtccacgctgcttttatgagctgtaacactcaccgcgaagatctgcagcttcactcctgagcccagcgagaccacgagcccaccgggaggaacgaacaactccagacgcgctgccttaagagctgtaacactcaccgtgaaggtctgcagcttcactcccgagccagcgagaccacgaacccaccagaaggaagaaactctgaacacatctgaacatcagaagggacagactccagacgcgccaccactctgctaacaccagatagtggaaagaaaccatgtgctgaaatgtttgacgacactgatggtttgactctgctaactggaatggcttattgtgcaagaaagtacacctggtcgggtcctggggctcatctctagcaccagcaaagatttctgaagacgtctttctagaaatgactggaaagtttcaagaggcataagatacagcatttcttctgaggccctgaagaagtatcaagtgggctttgacattgcggtggtgagagcgacccctcctcacctggagaactgggaaatgtggattctcagggaccgcgctgttcacgagctccaggctgtgctgctggccctggtcctggggcgctgagccgcatctgcaatagcacacctgcccggccacctgctgccgtgagcctttgctgctgaagcccctggggtcgcctctacctgatgaggatgtgcacccccattagggggctgctcatggcccttgcagtgatgtttgggacagcgatggcatttgcacccataccccggatcacctgggagcacagagaggtgcacctggtgcagtttcatgagccagacatctacaactactcagccttgctgctgagcgaggacaaggacaccttgtacataggtgcccgggaggcggtcttcgctgtgaacgcactcaacatctccgagaagcagcatgaggtgtattggaaggtctcagaagacaaaaaagcaaaatgtgcagaaaaggggaaatcaaaacagacagagtgcctcaactacatccgggtgctgcagccactcagcgccacttccctttacgtgtgtgggaccaacgcattccagccggcctgtgaccacctgaacttaacatcctttaagtttctggggaaaaatgaagatggcaaaggaagatgtccctttgacccagcacacagctacacatccgtcatggttgatggagaactttattcggggacgtcgtataattttttgggaagtgaacccatcatctcccgaaattcttcccacagtcctctgaggacagaatatgcaatcccttggctgaacgagcctagtttcgtgtttgctgacgtgatccgaaaaagcccagacagccccgacggcgaggatgacagggtctacttcttcttcacggaggtgtctgtggagtatgagtttgtgttcagggtgctgatcccacggatagcaagagtgtgcaagggggaccagggcggcctgaggaccttgcagaagaaatggacctccttcctgaaagcccgactcatctgctcccggccagacagcggcttggtcttcaatgtgctgcgggatgtcttcgtgctcaggtccccgggcctgaaggtgcctgtgttctatgcactcttcaccccacagctgaacaacgtggggctgtcggcagtgtgcgcctacaacctgtccacagccgaggaggtcttctcccacgggaagtacatgcagagcaccacagtggagcagtcccacaccaagtgggtgcgctataatggcccggtacccaagccgcggcctggagcgtgcatcgacagcgaggcacgggccgccaactacaccagctccttgaatttgccagacaagacgctgcagttcgttaaagaccaccctttgatggatgactcggtaaccccaatagacaacaggcccaggttaatcaagaaagatgtgaactacacccagatcgtggtggaccggacccaggccctggatgggactgtctatgatgtcatgtttgtcagcacagaccggggagctctgcacaaagccatcagcctcgagcacgctgttcacatcatcgaggagacccagctcttccaggactttgagccagtccagaccctgctgctgtcttcaaagaaggtcctgcagacattcgctttgtctgggagaagaatgggcgagctctggagacctgtgtccctgtgcagacccatgcactgcccgatggcagggcccatgcactcagctggctgcaggacgccatcagggaaagcgctgagtatcgctgctctgtcctctcctcagcagggaacaagacttcgaaggtgcaggttgctgtgatgagacctgaagtgacccaccaggagaggtggaccagagagctctctgcctggagggctgtggctggggagcacgaccggatgatgcagagctggaggaaggcgtgggaaagctgtagcaaggacaccctgtagccaccaggaaggagtccctgacaccgacctcaaccccaacaagaccctgctgccactgaccacagccacccccggagaaggcctggtcccccacaactgtgaactgtcttgcccaagcctgctctgaacacagccattgggccaccacctgatgggcagaggc

SEQ ID NO: 179765 - DNA, 2177 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  Uniprot ID: O95754
  ENST ID: ENST00000339773
  CDS Start-End: 98-1945
gagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatca

SEQ ID NO: 179766 - DNA, 4312 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  Uniprot ID: O95754
  ENST ID: ENST00000357877
  CDS Start-End: 150-2462
gggggcggagccgggcggtgtttcatccctcagcctcaggctgagccggaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattgatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaata

SEQ ID NO: 179767 - DNA, 531 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000416236
  CDS Start-End: 67-273
agtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgtcttcagaaggaaaaatagaggagggggatatgatcctttgaaaagatgtggaagaagctaggagacgtcacaaggttaaaagtgatcattggggcgattcacattttagactctgctgagaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaa

SEQ ID NO: 179768 - DNA, 578 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000434486
  CDS Start-End: 85-578
ccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggatgtgtccaggttccagcaggttgaaagacttgagagtggccgggggaaatgtccttttgagccagctcagcggtcagcagctgtaatggctgggggggtcctctatgctgccactgtgaaaaactacctggggac

SEQ ID NO: 179769 - DNA, 602 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000453930
  CDS Start-End: 67-602
agtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtg

SEQ ID NO: 179770 - DNA, 577 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000458114
  CDS Start-End: 101-250
accgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgattgactggatggttcctgaggctcacagacagaactgtaggaagaaaggcaagaaagagggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcg

SEQ ID NO: 179771 - DNA, 2672 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000446927
  CDS Start-End: 16-399
caggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagagggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgta

SEQ ID NO: 179772 - DNA, 2192 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000420077
  CDS Start-End: 126-608
atccctcagcctcaggctgagccggaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggacgaatgtcacaattttgtccagattctcgccattgccaatgcctctcacctcctcacttgtggcaccttcgcttttgatccgaagtgcggggttattggggggtcctctatgctgccactgtgaaaaactacctggggacggagccaattatcaccagagcagtgggtcgtgccgaggactggattcggacagataccttgccttcctggctgaacgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctag

SEQ ID NO: 179773 - DNA, 6007 bp, Homo sapiens
  Payload ID: 15427
  Gene Symbol: SEMA4F
  Gene Name: sema domain, immunoglobulin domain (Ig), transmembrane domain (TM) and short cytoplasmic domain, (semaphorin) 4F
  ENST ID: ENST00000611975
  CDS Start-End: 150-2363
gggggcggagccgggcggtgtttcatccctcagcctcaggctgagccggaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcgtcccccgctcggtgcccagaacctcgcttccaatctctgaggctgactcctgtctcacccggttcgcagtccctcacacatacaattactctgttctccttgtggatcctgcctcccacacactttatgttggcgcccgggacaccatcttcgctttatccctgcccttctcaggggagagaccccgcaggattgactggatggttcctgaggctcacagacagaactgtaggaagaaaggcaagaaagaggatgtgtccaggttccagcaggttgaaagacttgagagtggccgggggaaatgtccttttgagccagctcagcggtcagcagctgtaatggctgggggggtcctctatgctgccactgtgaaaaactacctggggacggagccaattatcaccagagcagtgggtcgtgccgaggactggattcggacagataccttgccttcctggctgaacgccccagcctttgtcgcagccgtggccttgagcccagccgaatggggggatgaagatggagacgacgaaatctacttcttctttacggagacttcccgagcatttgactcatacgagcgcattaaagtcccacgggtggcccgtgtgtgtgcgggggacctcgggggccggaagaccctccagcagagatggacgacgtttttgaaagctgacctgctctgtccagggcctgagcatggccgggcctccagtgtcctgcaggatgttgctgtgcttcgacctgagcttggggcagggactcccatcttttatggcatcttttcttcccagtgggagggggctactatctctgctgtctgtgccttccgaccacaagacattcggacagtgctgaatggtcccttcagagaactaaaacatgactgcaacagaggactgcctgtcgtggacaatgatgtgccccagcccagacctggagagtgcatcaccaacaacatgaagctccggcactttggctcatctctctccctgcctgaccgcgtactcaccttcatccgggaccacccactcatggacaggccagtgtttccagctgatggccaccccctgctggtcactacagatacagcctatctcagagtcgtggcccacagggtgaccagcctctcagggaaagagtatgatgtgctctacctggggacagaggatggacacctccaccgagcagtgcggatcggagctcagctcagcgttcttgaagatctggccttattcccagagccacagccagttgagaacatgaaattgtaccacagctggctcctggttggctcccgtactgaggtgacacaagtgaatacaaccaactgtggccgtctccagagctgctcagagtgcatcctggcccaggacccagtctgtgcctggagcttccggctggatgagtgtgtggcccatgccggggagcaccgagggttggtccaagacatagagtcagcagatgtctcctctttgtgtcctaaagagcctggagaacgtccagtagtgtttgaagttcccgtggctacagctgcgcatgtggtcttgccatgttctccaagctcagcatgggcatcctgtgtgtggcaccagcccagtggagtgactgcactcaccccccggcgggatggactggaggtggtggtgaccccaggggccatgggcgcttatgcctgtgaatgtcaggagggtggggcagcccatgtggtagcagcttacagcttggtatggggcagccagcgagatgctccgagccgggcccacacagtgggggcgggactggctggcttcttcttggggattctcgcagcatccctgactctcattctgattggtcggcgtcagcagcgacggcgacagagggaacttctggctagagacaaggtgggcctggacctgggggctccaccttctgggaccacaagctacagccaagaccctccctccccctctcctgaagatgagcggttgccgctggccctggccaagaggggcagtggctttggtggattctcaccacccttcctgcttgatccttgcccaagcccagcccacattcggctaactggggctcctctagccacatgtgatgaaacatccatctagagctgggcaaatgaccactagtgtataagtgatcactggaacggagtgaccactgagatgctgggggtcactgggcctggaagaccatcccagcctctgagttctctttgagtatgagtgattacttggattttagtatctgttctctctgagcctggatgggcttggggccagacctttgcctgattcctgattcccatgagaaatcagaactgctttctgcagcaaatcagggcttccccctaacatctgaactcctgtaaaccttcatccctggccccctatcttgggcccattagttttggggatggggcacagggcatagctatgactttgctttctggttggagcctggccggaaggaagagccctggaggtggttgggggcaaatgtgccctgagtccttggggtggttctgcttattcttcaagtttatctgaatctgtggggagtgcatgatccccatgttgcaatatggagtctctgccctgagatcttccccatctcagttttccttccatgaaagagtacgtgtaaatacatagtgttcataagagacctggccacatgtgcatgaatgactgggccgatgcttaggaatatttatgagggatggggagggagacaattggaatgggggcgttgcctgcagaactttagaccctgtagccatagagggaatggcgttcctttctaaaaggaactgaaacactgcccctctccccattgccccacaaccttactctaaatttgagtagagaaaagctcctaaagtgaccttccgggtgggaagggcagcagtacacatgaccccatccttttctttgtttttaccccctggctgccaccactgccatgtcacagctgctttctctggctggagtgtaggctgtaccccatttccttggctcccattaaaaatcaacaacattctaatgattagggaacaacagaaggggaacagtcataggatatacgagcagtataaagatacgtttgcaatcagtgactactcagggtgacacccttgccctaaagcaggagtcccccctacctggggtccatggactccctgaaattgtatgcaaaatgttgtttgtacatgtgtgtctgtatgtctctgtggggaggttttatggcttttgtcagattttcaaggccttaacaaagttaaaggaccactgccctgaggttactgcactgaggccaagttaggatggcatcactctgtggcagctctccctggacttgccctgcctggaacagggtgatttgctggaatggagttaccactgagatgccaaaggttgctgggtctggaagactgttgtggcctctcagttctctttgagtctgactgactgtggccagtccctggactggtagctgctggaggccttcttgtttctccagtccctggaagctgagctctatgtgtatttgatgacattgtcagctcttaccaaacgtcaagacctcttcctgcttgaccactcgcacatggctctaggcttctcctgctgagtcctggtcttggcctgtgaatgtgcctcgttcatccctggtgcttgagcccctcaagctccagtcaatgatccagtccttcccctttgaagttttctgctctactttccttggcagcagcctgtgaactactcaaaagagtccccttgggtttggaattatcagtggctttgccactagtaaatgtgtgatcttcggcaagtaacctaacctagggacatcagtttactcatctgcgaagtggggataataaaacctacctcagggttgcttcaaggattaaatgagaaaatatgtcaacaataaagacctgtctgtaccaatagatgttgttattgcaaaaatgggcttactatccataaccatatagcttaactatatgataaccatgacattcgtaggctgggcatggtggcttacgcctgtaatcccagcactttgggaggccaaggcaggtggatcacaaggtcaggagatcgagaccattctggctaacacggtgaaaccccgtctctactaaaaatacaaaaaattagccgggcgtggtggcgggggcctgtagtcccagctactcgggaggctgaggcaggagaatggcgtgaacccgggaggtggagtttgcagtgagccaagatcacgccactgcactccagcctgggcaacagagcaaaactccgtctcaaaaaaaaaaaaaaaagataaccatgacactcgcaatcatattaagcctcactcagtaaaggacagtcattgtttcacagatatcctgttctgggtcacctctggacagctcatagctgctggtttctaggttttaggaggcagatctatgatttttgtaatcctcagacctgtctgaccttagtggcctgagatccctttgtatagaatggaggaaggctgtgtgttctttggtttaccctcagcctatctttcaaccccactcacttgaggttgtggcctagttcctctttgggggagggaggaaggtggggagatgtcaaaggggactgggcttcctgtggggagtgggagagaagagtttttcaaggaggagagagaccagggctcttatactctgggccactatctgcctgctctaatcacctagggccaggcaccagacaactagggatggcctctttaccccaaagcctgctgaaattactcaaactagccaatcctaagtctgcctaccctgcctcagtcattccttccaatggaaaccacaataagcactcttgcccacgttttccctgctccctctgcatcccaactgaccctggtgcttccccatgtggcccctgtatagtgtgctttgcctcctgtttctagggacctgtgagtatcagctttctcgatgacagtcatttctgtgtctatgtgtcttattataccttattaaaacaaacctgggtacatttgtaagacagcagggattctctgaagattaatgattgagaaggatgattggacctgtctagtcagggaggctgaggcctcaggccttcattaggcacgttgcatgtctgtcaagtaagggccactaatcacctcacatgggttcatctgaactttatgccagcccaaaacacgaggacgtgccacccatcctcagcactctcaagacacacttaagtgtgtttgatacgtaagctccaattccttcctccataagaagagagaaggcagaagtggctttccccgaggtgaggacggggatgggagttttttcttttgagtgatgtagacctatgccctgcttccatgccacttcctcagatgtgacagacctctgctgggatggaatgtgtgtttgctggagacagctgtggcatagaggattgtgagaaagggtccccatgcttggtgtggaaggagggagctgctcaccctctgtatgggcttggatgaggagcttctcagcggcagtcataagaaccagaggattttctgccctttgctgggagccacatgagccccctggattcatgtggaattcttgggagagggatgaccaccctgaagatggctgagatcaaatatctcatcagatgactggatgcttagaatcgggttaacttgattaaataaataaatagaaatagtttttgtacct

SEQ ID NO: 179774 - DNA, 4094 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENST ID: ENST00000210633
  CDS Start-End: 79-2610
gcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccac

SEQ ID NO: 179775 - DNA, 3596 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENST ID: ENST00000370250
  CDS Start-End: 374-2890
cagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggtaggtgctccctcaggatcaggtgccctgcagacccagagccagttcctatcccctaacctaaacacttataggtgaggactccatcctcctgttccattcatctgcccaaaccctttctctttctcccaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcct

SEQ ID NO: 179776 - DNA, 2024 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENST ID: ENST00000519649
  CDS Start-End: 459-2024
cctctcgcagctggtgctgtggggccgcggagccgcgcgtcgctgtctctatggccccggatccgagcgcaaagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagac

SEQ ID NO: 179777 - DNA, 393 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENST ID: ENST00000476171
  CDS Start-End: 1-393
gcgggaaggcagacgagggcgccgacggaaatactcactgggtcgggccagccgggcaggaggatctgcggtgcaactgcagacagtctcaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacggg

SEQ ID NO: 179778 - DNA, 596 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENST ID: ENST00000518124
  CDS Start-End: 85-596
gctggtgctgtggggccgcggagccgcgcgtcgctgtctctatggccccggatccgagcgcaaagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggctt

SEQ ID NO: 179779 - DNA, 2675 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENST ID: ENST00000517724
  CDS Start-End: 202-2310
ccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggtcccagggaagcaggacagcactgatacaggacatagagagaggaaatcgaggctgtgagagcagcagggatacaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttgga

SEQ ID NO: 179780 - DNA, 4656 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  Uniprot ID: Q9NTN9
  ENST ID: ENST00000521006
  CDS Start-End: 787-3303
cgcagctggtgctgtggggccgcggagccgcgcgtcgctgtctctatggccccggatccgagcgcaaaggtgagcaaggcgaggagtgcgggcggcgccctggcgtgagcctggggctgcgggccgggggtcgggcaaggcctcccccacgtccattctaccctccaagctgggccaggcctttctcaccaccaagtcccccggtcctgcatgacggctctagaggggcgcgggccaggcctcgggctgcgcggggtgcaaaccggccaccacggagtcggggaccagcgcggggagggggccgcgtggcgaacagtgttccccaggatctgggtcacgtctcccggcgtccggcgggatcgaaggagagcttgtcctcgagctgcagcagtagagactgagaaaacggacctcagaaaaccaggactagctctactgtcgggggcagggtgaccccatcagtaacctacaacccctctagaacttcacaactccctctcaccatggagtttgcatttgatgcagaaaggcatgtgatccctccctccttctgacctcttagctggggattccatggccacacaaccctgtgactccatgtccccccgattccaggaccccccatggccccatgattccttgactcctatgaccttatgacccctgaccttccaagtgacttccttggactttgacccctgtgactgtgcttcccattccccgcccccacaacctgtgactctggctccctttgggggtcttgttagtctgggcctccccaggaagatgtgggggaggctctggcccctcctcctcagcatcctcacagcaactgcagtcccaggaccctcactgcggagaccgtctagagaactagatgccacccctcggatgaccataccctatgaagagctctctgggacccggcacttcaagggccaagcccagaactactcaacactgctgctggaggaggcctcagcaaggctgctggtgggagcccgaggtgccctgttctctctcagtgccaacgacataggagatggggctcacaaagagatccactgggaagcctccccagagatgcaaagcaaatgtcatcaaaaagggaaaaacaaccagacggagtgctttaaccatgtgcggttcctgcagcggctcaattctacccacctctatgcatgtgggactcacgccttccagcccctctgtgcagccattgatgctgaggccttcaccttgccaaccagcttcgaggaggggaaggagaagtgtccttatgacccagcccgtggcttcacaggcctcatcattgatggaggcctctacacagccactaggtatgaattccggagcattcctgacatccgccggagccgccacccacactccctgagaactgaggagacaccaatgcattggctcaatgatgcggagtttgtgttctccgtcctcgtgcgggagagcaaggccagtgcagtgggtgatgatgacaaggtgtactacttcttcacggagcgtgccactgaggagggctctggcagcttcactcagagccgcagcagtcaccgtgtggcccgtgtggctcgtgtctgcaagggagacctgggagggaagaagatcctgcagaagaagtggacttccttcctgaaagcccgtctcatctgccacattccactgtatgagacactgcgtggggtctgcagcctggatgctgaaacctcaagccgtacacacttctatgcagccttcacgctgagcacacagtggaagaccctggaggcctcagccatctgccgctatgacctggcagagatccaggctgtctttgcaggaccctatatggaataccaggatggttcccggcgctggggtcgctatgagggtggggtgcctgagccccggcctggctcgtgtatcacagattcattgcgcagccaaggctacaattcatcccaagacttgccatccctggtcctggactttgtaaagttgcacccactgatggctcggcccgttgtgcccacacgtggacggcccctgctgctcaagcgcaacatacgctacacacaccttacagggacacctgtcaccacgcctgctggacctacctatgacctgctctttctgggcacagctgatggctggatccacaaggccgtagtcctgggctctgggatgcacattattgaagagacacaagtgttcagggagtcccagtctgtggaaaatctagtcatctctctattgcagcacagcctctatgtgggggctcctagcggagtcatccagctaccactctccagctgctcccgctaccgatcctgctatgactgcatcttggcccgagacccctactgtggctgggaccctggcacccatgcctgcgcagcagccaccaccatagccaacaggacagcactgatacaggacatagagagaggaaatcgaggctgtgagagcagcagggatacagggccaccaccaccactgaagacccgctctgtgctccggggtgatgatgtcctcctgccctgtgaccagccatccaacctggcccgggccttgtggctactcaatgggagcatgggcctgagcgatgggcagggtggctaccgtgtgggcgtggacgggctgctggttacagatgcacagcctgagcacagtggcaactatggctgctatgccgaggaaaatggcctccgcaccctgctggcctcctatagtctcacagtccggccagccactcctgccccagctccaaaagcccctgccacacctggggcacagctggcacctgatgtgagactgctctatgtgctagccattgccgcgcttggtggcctctgcctcatcctggcctcctccctcctctatgtggcctgtctgcgggaaggcagacgagggcgccgacggaaatactcactgggtcgggccagccgggcaggaggatctgcggtgcaactgcagacagtctcaggccagtgtcctggagaggaagatgagggtgatgatgagggggctgggggcctggagggcagctgtctccagatcatccctggggagggagccccagccccaccacccccaccgcccccaccgccaccggctgagctgaccaatggcttggtggcactgcccagccggctgcggaggatgaatggcaatagctatgtgcttctgaggcagagcaacaatggagtaccagcagggccctgctccttcgccgaggaactcagccgcatcctggaaaaaaggaagcacacgcagctcgtggagcagctagatgagagctctgtctgagcccagcctcccagaacaaatgctcttccaagccagcctatctgtcccaggctgggccactgcctccctaacacagccaccctcccttcattacccccactccatacccttctcccaactttttgatgtccctgtagggctggccagtcaggcccagccaaagccccctcctcagtctccacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttccccaca

SEQ ID NO: 179781 - DNA, 1171 bp, Homo sapiens
  Payload ID: 15428
  Gene Symbol: SEMA4G
  Gene Name: sema domain, immunoglobulin domain (Ig), transmembrane domain (TM) and short cytoplasmic domain, (semaphorin) 4G
  ENST ID: ENST00000613292
  CDS Start-End: 68-451
cacagacccacatgtgagcagcccaggcccatcggtgctcctcagaggcagggctctgcaggtccatatgggctcaatgtcaccaccctctgcatggccctgtgtgctggatggtcctgaaaccagacaagacctctgccagccacctaagccctgcgtacattcacatgcacacatggaagaatgtttatcggctgggctgcagtgcccccaccctcaccttctcctggtgcattcttgtttcatccctgcttctggacttggggtaccctcccaattgccacatcctatctggtcctcttccccagccccatgtggtgacctctttgtcaagagcttgggaacgggccagcctggggaggtaagactgcatcactcccctcctctcccttcctgtgtggcccttgtgaatcagcctccccactctccttggtcattctcaagagtatgagagacagagctccaggcatgtcccatccccatgcacatgtggtaacacacacctgtatcacacatgtgcttacatttccactcacatgcacctctgagcctcccttgctgtcttggacctgtctgttgggtttagtccgtggacatttcagagggagatccccctcccatttaactgtcctcacaggcccttgcctaggatggatgaccaacactgcactcaatgagccagcctctcttttgggggaatcaagcatttgcttcctctagactacagcagggaaagggaggagaaatctgatgtctcaactggcacatgaagcccattcttggaactatgcaaagggcagaggctgggagtttggacgcttagctcctacccctgtcctacctcaccggggcactttcaggggccaggggcctctgaagtctctaggcctatatgggacaatcaattctgactgagctcccccattcccctcgggtgaggatgactgttatttttgtagctgagaacgtggaatcccacgggtttttactgcccttcacccaacctctcccacctccaccccacaatgaatgtatttattgtgagaatggctacacttctttaggaatgcccccacttacaaccaggtgggtggaacaggcatgtgacagagtggggagcctgggctcagctcctccccctgccgttggttaataaacaccctttttcccc

SEQ ID NO: 179782 - DNA, 11762 bp, Homo sapiens
  Payload ID: 15429
  Gene Symbol: SEMA5A
  Gene Name: sema domain, seven thrombospondin repeats (type 1 and type 1-like), transmembrane domain (TM) and short cytoplasmic domain, (semaphorin) 5A
  Uniprot ID: Q13591
  ENST ID: ENST00000382496
  CDS Start-End: 667-3891
acttgccgggaaggcggcgccggtggcggctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacattttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaataccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcctcggctggattttcatcatcagatatttcaactcatctcatcagtttcttgtaagaaaaaaacattttcactttgtagcacattttagttatttttgagtcttcttccctaatagtttgtaagcttaaagggacattttattttccctggtaaagaggattctaatatttcaagaatgtttcactggaattgatgggaaatggtttctaaatggcatcgaagctggtctttaatgagtcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccttcctgccttcttttcttctttcctttcttctttctttaattcttcctttcttcctattttcttggtacaagtggaacaaaaaccaacacatagttttaagctacacctttctgcacctgatgtaaaatgacattaatcactatttaacttctaaaattatttctgaatacagttggagataggctggttttcatgaggaagctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagtccgttcatgtcatgtggtttgggatgaaccaggggtctggccccatcgggtcacaggtgatggcaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaaaaaaaagaacaaagtcttagcggggggtctctatgtccccaagtggctctctaaggggatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatggggttttcttgtgtgtgtcattgggggtaactccattgacctcagcatttctatctcaagagatggctctggaacacagaaccagaggcaacaggtactaatggttgataaaattaacagcgactgcataaccattttccacatggcagggctgtgcttaagccccacacctccaataatcaatttctatgacggtactaataaccttaactatatgcaaattcttcaccacttatgatatggtacaaactggagtttacagatggccttggccttgcctagcccatttgttcatcctaacttcttcatcacttcctgatgcacttggggaagcatgttgacacaacgttaccaatatttgattacctatggttatctgcaattacctacgcttatcttatcagaccctagatgccatttgagccccttacttctttgggcagtgggtgaaatgggagaacatagagaaatgttcactttgacctaagaaacgcataaaagggaatgccatgcacaatgtaagataaaatgtttggggacaggggatcatcgtgaaatttatttctgctattctgccctattgaggtcattaattataatggatttaaagatttttttttaaactctacaaacactaagccaaggaattcaggttatctgctatgttaacctaataaagcaaaggaaaataagttgctttaatccttgcttgttaacctaataaagcaaaggaaaatatgttgctttaatccttgcttcttttctcttttggtaatagaaaaggtaaataagatgtaatgttgaactgctggtgatgatttctaaaacgactctttaaatactcctttcctatggacttatattaaagatgcattgtacacattgttttagcagatagatcaaagatatactcagtggtcatctgttgcattatcagaaatttgatacatgttacagaagcatgaggaagggaatcctatccacttttgaaaatagagttcacattgcaagcgacatagggcattatcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagaggaggtagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatttatcatttcatgtggatattattggtctaattagaaggagaagattgattggatttactttaaagaaaattattctcctatgtctctttgaactcaggaatagaaaatgaccaagaagcacatcatcttcagatgtgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttgaaacaaagcacagtatgaatctttaacccaagcacttagtttcaccactgagattctacatcatctgcaagaaaatgcacaaacttttggtccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttaggggacaattta

SEQ ID NO: 179783 - DNA, 935 bp, Homo sapiens
  Payload ID: 15429
  Gene Symbol: SEMA5A
  Gene Name: sema domain, seven thrombospondin repeats (type 1 and type 1-like), transmembrane domain (TM) and short cytoplasmic domain, (semaphorin) 5A
  ENST ID: ENST00000513968
  CDS Start-End: 173-935
attcatacacacacacgacctgggatatgactagaaaaatatgctgctctaagccctccaagctctcctctatctccacaaagtgtaaccttaaagcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgca

SEQ ID NO: 179784 - DNA, 4523 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000195173
  CDS Start-End: 400-3573
aactcctcccccaccgccccctccctccttctgctcccgcggtctcctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggaggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 179785 - DNA, 4792 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENST ID: ENST00000357599
  CDS Start-End: 388-3843
aactcctcccccaccgccccctccctccttctgctcccgcggtctcctcctccctgctctctccgagcgccgggtcgggagctagttggagcgcgggggttggtgccagagcccagctccgccgagccgggcgggtcggcagcgcatccagcggctgctgggagcccgagcgcagcgggcgcgggcccgggtggggactgcaccggagcgctgagagctggaggccgttcctgcgcggccgccccattcccagaccggccgccagcccatctggttagctcccgccgctccgcgccgcccgggagtcgggagccgcggggaaccgggcacctgcacccgcctctgggagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 179786 - DNA, 3791 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000393583
  CDS Start-End: 528-3791
agtgcttttgtctggtgctgggagtgaggctcagcagtgtgagggacaattggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccg

SEQ ID NO: 179787 - DNA, 4579 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENST ID: ENST00000451055
  CDS Start-End: 12-3629
gtataaaccacatgctgcatctgtcagcagaggaagccattggctgcgtgagggtcagaaggagcttcatagatgagctggcatttgggagagggcattctacagggacgggcaagcagaagcgaagggatcgagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 179788 - DNA, 1542 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000451541
  CDS Start-End: 1-593
cccgttcctgcaccagccccgcaccctccccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 179789 - DNA, 558 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000449546
  CDS Start-End: 307-558
agacatccgtgttccctggctcaggggctcatcgtccttccttcctctgccaaggctgaggcgcagctggacaggggagcatccatcacactcctttcccgccagccagcagcggcagctctcctggcaggcaggggatcagctgtgcctctccttactccactgctcctcacccctggacccagggcccaccctccatctctccttgtctggtgctgcccacgtctgcctgcagaccacacctgtgagcacttgactaagtcttctgtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcc

SEQ ID NO: 179790 - DNA, 716 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000421053
  CDS Start-End: 290-716
gcggccgccccattcccagaccggccgccagcccatctggttagctcccgccgctccgcgccgcccgggagtcgggagccgcggggaaccgggcacctgcacccgcctctgggagccagcttgggtccgggttgcactgggccctgccagggctgtggtcggcgcatctgggctgcagcggcgatggggacccgggacccaggcctggagaaggagacggacgagtgaggctgagggacggagggacagagtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagcca

SEQ ID NO: 179791 - DNA, 4733 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  ENST ID: ENST00000475244
  CDS Start-End: 198-3482
caattcggcctcgctccttgtgattgcgctaaaccttccgtcctcagctgagaacgctccaccacctccccggatcgctcatctcttggctgccctcccactgttcctgatgttattttactccccgtatcccctactcgttcttcacaattctgtaggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcaggtaaaagaaaccggacctacctcatgctgcggtcctcccagccctccggcaccccactccaaagtctggactctttccacatcctgctccagacagccaagctttgttggggtccccactgctttgagatgggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctc

SEQ ID NO: 179792 - DNA, 4933 bp, Homo sapiens
  Payload ID: 15430
  Gene Symbol: SEMA5B
  Gene Name: sema domain, seven thrombospondin repeats (type 1 and type 1-like), transmembrane domain (TM) and short cytoplasmic domain, (semaphorin) 5B
  Uniprot ID: Q9P283
  ENST ID: ENST00000616742
  CDS Start-End: 528-3983
agtgcttttgtctggtgctgggagtgaggctcagcagtgtgagggacaattggagatgctcgggggcaggctgccgcgttgtgtcctgcttttctgcggccagaccaagccgtctggagctgctggtcaggttttcttgctgacctcacctgaccacagtggcctgggtggactctacagggaaatgttgttttctccctgggagcagtagcagcagtcctggctcccctggactgagaactcctcatcagccccaggaagcccggaccccctttcagggatctggaaccggtgtgcctgtggccccaggtctgctcccaggcgtgggctgaagtcctgacttctgtcgctgggggcaaggagtgggagagcccagctgctgcctgggctttggcagacagcaggctgatggtgctggcttccccgagactgcttctcctgcctgctgtctgatttccctgcatggtgcccgcagctgagctgctacggtgagtggttccagctggtgcctggcctgtgtctcttggatgccctgtggcttcagtccgtctcctgttgcccaccacctcgtccctgggccgcctgataccccagcccaacagctaaggtgtggatggacagtagggggctggcttctctcactggtcaggggtcttctcccctgtctgcctcccggagctaggactgcagaggggcctatcatggtgcttgcaggccccctggctgtctcgctgttgctgcccagcctcacactgctggtgtcccacctctccagctcccaggatgtctccagtgagcccagcagtgagcagcagctgtgcgcccttagcaagcaccccaccgtggcctttgaagacctgcagccgtgggtctctaacttcacctaccctggagcccgggatttctcccagctggctttggacccctccgggaaccagctcatcgtgggagccaggaactacctcttcagactcagccttgccaatgtctctcttcttcaggccacagagtgggcctccagtgaggacacgcgccgctcctgccaaagcaaagggaagactgaggaggagtgtcagaactacgtgcgagtcctgatcgtcgccggccggaaggtgttcatgtgtggaaccaatgccttttcccccatgtgcaccagcagacaggtggggaacctcagccggactattgagaagatcaatggtgtggcccgctgcccctatgacccacgccacaactccacagctgtcatctcctcccagggggagctctatgcagccacggtcatcgacttctcaggtcgggaccctgccatctaccgcagcctgggcagtgggccaccgcttcgcactgcccaatataactccaagtggcttaatgagccaaacttcgtggcagcctatgatattgggctgtttgcatacttcttcctgcgggagaacgcagtggagcacgactgtggacgcaccgtgtactctcgcgtggcccgcgtgtgcaagaatgacgtggggggccgattcctgctggaggacacatggaccacattcatgaaggcccggctcaactgctcccgcccgggcgaggtccccttctactataacgagctgcagagtgccttccacttgccggagcaggacctcatctatggagttttcacaaccaacgtaaacagcatcgcggcttctgctgtctgcgccttcaacctcagtgctatctcccaggctttcaatggcccatttcgctaccaggagaaccccagggctgcctggctccccatagccaaccccatccccaatttccagtgtggcaccctgcctgagaccggtcccaacgagaacctgacggagcgcagcctgcaggacgcgcagcgcctcttcctgatgagcgaggccgtgcagccggtgacacccgagccctgtgtcacccaggacagcgtgcgcttctcacacctcgtggtggacctggtgcaggctaaagacacgctctaccatgtactctacattggcaccgagtcgggcaccatcctgaaggcgctgtccacggcgagccgcagcctccacggctgctacctggaggagctgcacgtgctgccccccgggcgccgcgagcccctgcgcagcctgcgcatcctgcacagcgcccgcgcgctcttcgtggggctgagagacggcgtcctgcgggtcccactggagaggtgcgccgcctaccgcagccagggggcatgcctgggggcccgggacccgtactgtggctgggacgggaagcagcaacgttgcagcacactcgaggacagctccaacatgagcctctggacccagaacatcaccgcctgtcctgtgcggaatgtgacacgggatgggggcttcggcccatggtcaccatggcaaccatgtgagcacttggatggggacaactcaggctcttgcctgtgtcgagctcgatcctgtgattcccctcgaccccgctgtgggggccttgactgcctggggccagccatccacatcgccaactgctccaggaatggggcgtggaccccgtggtcatcgtgggcgctgtgcagcacgtcctgtggcatcggcttccaggtccgccagcgaagttgcagcaaccctgctccccgccacgggggccgcatctgcgtgggcaagagccgggaggaacggttctgtaatgagaacacgccttgcccggtgcccatcttctgggcttcctggggctcctggagcaagtgcagcagcaactgtggagggggcatgcagtcgcggcgtcgggcctgcgagaacggcaactcctgcctgggctgcggcgtggagttcaagacgtgcaaccccgagggctgccccgaagtgcggcgcaacaccccctggacgccgtggctgcccgtgaacgtgacgcagggcggggcacggcaggagcagcggttccgcttcacctgccgcgcgccccttgcagacccgcacggcctgcagttcggcaggagaaggaccgagacgaggacctgtcccgcggacggctccggctcctgcgacaccgacgccctggtggaggtcctcctgcgcagcgggagcacctccccgcacacggtgagcgggggctgggccgcctggggcccgtggtcgtcctgctcccgggactgcgagctgggcttccgcgtccgcaagagaacgtgcactaacccggagccccgcaacgggggcctgccctgcgtgggcgatgctgccgagtaccaggactgcaacccccaggcttgcccagttcggggtgcttggtcctgctggacctcatggtctccatgctcagcttcctgtggtgggggtcactatcaacgcacccgttcctgcaccagccccgcaccctccccaggtgaggacatctgtctcgggctgcacacggaggaggcactatgtgccacacaggcctgcccagaaggctggtcgccctggtctgagtggagtaagtgcactgacgacggagcccagagccgaagccggcactgtgaggagctcctcccagggtccagcgcctgtgctggaaacagcagccagagccgcccctgcccctacagcgagattcccgtcatcctgccagcctccagcatggaggaggccaccgactgtgcagggttcaatctcatccacttggtggccacgggcatctcctgcttcttgggctctgggctcctgaccctagcagtgtacctgtcttgccagcactgccagcgtcagtcccaggagtccacactggtccatcctgccacccccaaccatttgcactacaagggcggaggcaccccgaagaatgaaaagtacacacccatggaattcaagaccctgaacaagaataacttgatccctgatgacagagccaacttctacccattgcagcagaccaatgtgtacacgactacttactacccaagccccctgaacaaacacagcttccggcccgaggcctcacctggacaacggtgcttccccaacagctgataccgccgtcctggggacttgggcttcttgccttcataaggcacagagcagatggagatgggacagtggagccagtttggttttctccctctgcactaggccaagaacttgctgccttgcctgtggggggtcccatccggcttcagagagctctggctggcattgaccatgggggaaagggctggtttcaggctgacatatggccgcaggtccagttcagcccaggtctctcatggttatcttccaacccactgtcacgctgacactatgctgccatgcctgggctgtggacctactgggcatttgaggaattggagaatggagatggcaagagggcaggcttttaagtttgggttggagacaacttcctgtggcccccacaagctgagtctggccttctccagctggccccaaaaaaggcctttgctacatcctgattatctctgaaagtaatcaatcaagtggctccagtagctctggattttctgccagggctgggccattgtggtgctgccccagtatgacatgggaccaaggccagcgcaggttatccacctctgcctggaagtctatactctacccagggcatccctctggtcagaggcagtgagtactgggaactggaggctgacctgtgcttagaagtcctttaatctgggctggtacaggcctcagccttgccctcaatgcacgaaaggtggcccaggagagaggatcaatgccataggaggcagaagtctggcctctgtgcctctatggagactatcttccagttgctgctcaacagagttgttggctgagacctgcttgggagtctctgctggcccttcatctgttcaggaacacacacacacacacactcacacacgcacacacaatcacaatttgctacagcaacaaaaaagacattgggctgtggcattattaattaaagatgatatccagtctcc

SEQ ID NO: 179793 - DNA, 4256 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000257414
  CDS Start-End: 250-3393
gaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgacatttcaactcctctaccagataatgaaatgtcttacaacacagtgtatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaat

SEQ ID NO: 179794 - DNA, 6878 bp, Homo sapiens
  Payload ID: 15431
  Gene Symbol: SEMA6A
  Gene Name: sema domain, transmembrane domain (TM), and cytoplasmic domain, (semaphorin) 6A
  Uniprot ID: Q9H2E6
  ENST ID: ENST00000343348
  CDS Start-End: 789-3881
gggtcggaggagacgccagccaaagtaggcggagttgcggaaggagagtccgatctgcgcaatccagtccgggacttggctccgcccgggagcggcggcctctccggtgacagaggagtagtgagcggcacggggtgaggctgcagccaactccgctccccgcgcactcggctgcccaggcgctcggaacccagcagcggcgctcctccgcggtgccggtcgcccgcgatgcccgcttagcagcgtgtagcagcggccagcatcaccacacccgcggcaccgcgctgccggccgcagagccgggccagagccttgcacccctgccccagcccccaccccgccccccgccctgaaatgacttgttaatcggcgcagacaccaccaaggggactcaccgaagtggaatccaagtggaatttggatttggagaagagtttcttgaacatttaccctcttccttgttggttttctttttctttttcttctttttttttttggcttcttttttcctctccccttctccgctcgtcattggagatgaacacatcgcgtttgcatcccagaaagtagtcgccgcgactatttcccccaaagagacaagcacacatgtaggaatgacaaaggcttgcgaaggagagagcgcagcccgcggcccggagagatcccctcgataatggattactaaatgggatacacgctgtaccagttcgctccgagccccggccgcctgtccgtcgatgcaccgaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatcaagaaaatttaaaaagacaaaaaaaaaagaattcattgataattctaactcagactttaacaatggcagaagtttactatgcgcaaatactgtgaaatgcccgccagtgttacagctttctgttgcagcagataaatgccatgttgggcaactatgtcatagatttctgctcctcctctcttttaatgaaataacgtgaccgttaacgcaagtaactctttatttattgttcaccctttttttccttaaggaaaggactcttccaaatatcatcctatgaacagctcttcagaaagcccattgaaagttaaactatttaacgtgaaatccattaactggaataattgagtttctttatttttacaataaattcactgagtaaataagttggagctggaattctgagctttgtgtttggactgtctggtctgtagctaaaggaaaaagttaggaggggaatatttatttaaatctatcagttcattgcctggtcaggtctctggcctataaacatgcaaaaaaactaattcatgttaaagtccttccagatcctaatttctaaagcaatcaggagagaaagcttttagaatggcacatcatatctcattgatgccaacatggttttgtccatggttctgactttctgtgaaggcaccagcttgcaatatgccatcccatttcaccttgcatgtgagacagcaaacaaaatccacaaatggtgtgaactaatatgctggctgctaccttgcataaattaatgatttgatcacacgggttcttcgtggggttacatctgtgaatagcctgttttccacatgtaaatttgtgccttacaccttgagttgtgtacacttgtaaactctttatgatcaactgttcccccttttgaaataagtgcagatatttatttaaccctcccttccccaccctctgccccacttccagccctctgaaagattggagtcaagcagatggaagaatgcagtggtgatagttgtcatgcgacagcctgagaacgctgggcagcaccacaccctccaattcacactgccttctagttgtgccaactggaaccaccctttggctgtgctgcgaagcatggaccccagtgttgttgtgggtgtgtcaaatcccctttcatcctcaagagctccctgcttcccttagattatttcaatacggtgatatccttatttgctagcagaaaagggactaacgtcccattcctcttttctgctgcgtccactggctagagagcaggcggtgcgcggttgggcagacacctgggaggagtctccaagccatgtgcacagcacacacgtgcagtgcacacaaagaaatgacatggaaatagatgcaggcaggctggtccctgctgtgattaacgagtaactccaagtacaaggccgaccacaatggatgctgcaaaaacgttgactggggcaaaggattttttattttattttttattttgttaattatgtttttaggggatgggaggtggtgtgtgtttttctcctcttggttttcatttgctcaagcacacaaaagggacttttgtttactctatcatgaacaaaggaactgtccacatactgtaaaccatgagcagtgttgttgttgtttttttaaacagtatatttggtggtctctttgtctgcttttatttccagttcgatcttctgggtttagttttgtctttaaaaagaattcaaaaaaagactgacaatgacagttttgagttggatagtgaaaaagtggagcctccataatcagtgtggttgccttcagacctgagtacttagctgagggtgggtgagagccctttgttccaaaagtccattagttttgctgttgtttaggagtaggtggttgttgttgtttttactttttttttttttggcttttgtaatggaatccatgttcacatcctgtgaactctgtctcctgaaaccctgaagtatttcctagaacctgaaatattgttttcttccttgaattttctctagaaatgcagaaattaggaaggtgatgggtctgtatccccctgcccccttctttcccatgcttgactcccgagagtactggcagtgcagcacccatcattgacgtaagcggctgtcttgtccagtgtttgtaggcatcactgcctcagctgttaaggagacctgtgtcaaaacttacatccacattcctacacccccacaacccatcacttctggtgttaaccctaaaatacccacatgtattgagctggtcttctgcatttaagtatttctccccagtttttttccccactgtgtgtggggggagggtccataaacccgagtgtgcctttgctttccacccttgctagacactggtagatgcaacaaactcagatttatatttgttgtaaagttgtaaaaatattgtgatgtcaccaattttccttccatctccacatcccctaacatctgattcacgacttaatgtatgttgtaagaaaagaaaaaagaaaagaaaaaaagggaaaaaa

SEQ ID NO: 179795 - DNA, 563 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000515009
  CDS Start-End: 85-563
gactcgggctccccaggacaatgtctctttcttcaccaagctgatgggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcag

SEQ ID NO: 179796 - DNA, 2116 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000515129
  CDS Start-End: 1-1637
catatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 179797 - DNA, 3640 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000513137
  CDS Start-End: 1788-3161
tatttctaattatttgcttatgctgggcactgaattttctcttaggctgaccatatattttattaaagtagtcttgaattcaggagtggaaaaaaaaaagttatgttttagacctcaatgtaagctgaaaggaaataaaggaacttctatatttccatttctcaggctgattttccttcccctgttctcttatctgtatcatgacatgagatgtgaacctcagaaatgtaaaaacaaaaagtctagaataaagcattccttgaattttaaatgaacatgcttttagcagctggatacgaagcagactattttcaacaaattgaatgtttcccacttgtgtgagagccaaacaagtgccatacagaaagggacctcttcaatgttaccaaagctttgtggcagcatttaagtgtggtggctccatagaagtcactatagcatggacgagccacttggcttgctttttcctgctaatcaaagttttaagaagataaaaagctatctttgttatatatgttttgtctaatttgcaatattacagtctcctggggggaaatccaacttccaataataattgtaaaaaaaaaaaaagaatgcactgtacttattcttttaatctgtctttctagaggccaatattttatttatcatgtgcatggtgatcatacttcaaggctggagcttttggagttgttgtgagtctgccctactttccaccaaaggcaccaattatacatgcacagtagttgcccttgtatcttttaaaaattgttcaagaggttgttctgtgtaagccaataactccacttgaaaatcacgaggaggtcatattttatttctgccagagagaacaggtatcattgtgccagcttggatcaaagcacctgatacaatctgtatttaaccttgtggaatgatggagggagagcttacaaacgaattcacaggaaatggctagagtttctgctgtaactctcaacctagccattcttctcatattatcctatggtagcttatctgaacctcagaaatctatccttttctaatttgaatcattttagtcaacgcagcctcagaaacggaaaccatctattgaaataatacacaaaagggacagccgtaatagcgtgtagccgttgaagcctccattccaatgaaaagacagtgggaatagatccctttggaaaccactaactaatcccagaaagaggaatgcctgtgaagttgagttgaacctgaagactagacacactgtagaacctccataggaagggtgcagagtaactgagttacttgtgatagggacaagacttacccactaccagaaacctgccccatcggtcacaaatgggattcccagagtggacactttctgtgtttagtgctgccatgggaatatcaaagaaggacactggcctttcttgagcacctatgtgtcagacactgtgcaagatgctttcaccattatgtcactatcctcccaacaccgagaggtatctttatccccactgggtgcacaggaagaggttaagtgattccctgaggcccacccagcaagtatgagagataggatctggcccttcattttctaactacaagttcaatgggctttctgctgaacacaccccacaccaccaccaccaccaccaccaccaccaccactaagccgtgtcatttctagggccatctcctctcagtcttacagccagcttgggtgtcccacctccaggcctctgcgcaaagggaatgtgggtctctctggtgatgttttcctaactgtatttgtgatgaaaacagggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacacaggggtactcacgaaaactgggccgcgtggtttggtgaaggtttgcaacggcggggactcaccttcattctcttccttcactttcccccacaccctacaacaggtcggacccacaaaagacttcagttatcatcacaaacatgagccaaaagcacatacctaccccatcccccacccccacacacacacacacacacacatgcacacaacacatacacacacacgcacagaggtgaacagaaactgaaacattttgtccacaacttcacgggacgtggccagactgggtttgcgttccaacctgcaaaacacaaatacattttttaaaatc

SEQ ID NO: 179798 - DNA, 3292 bp, Homo sapiens
  Payload ID: 15431
  Gene Symbol: SEMA6A
  Gene Name: sema domain, transmembrane domain (TM), and cytoplasmic domain, (semaphorin) 6A
  Uniprot ID: Q9H2E6
  ENST ID: ENST00000510263
  CDS Start-End: 200-3292
aatgcgttactgtgtggactgagttcccatgactcgggctccccaggacaatgtctctttcttcaccaagctgatggtaaatatctggttagcttcatctatttaaaaccagccaagcaggaatcctagtgctggagagaggattctttttttttttgtttggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataaggatgagtgccacaactttattaaagttcttctaaagaaaaacgatgatgcattgtttgtctgtggaactaatgccttcaacccttcctgcagaaactataagatggatacattggaaccattcggggatgaattcagcggaatggccagatgcccatatgatgccaaacatgccaacgttgcactgtttgcagatggaaaactatactcagccacagtgactgacttccttgccattgacgcagtcatttaccggagtcttggagaaagccctaccctgcggaccgtcaagcacgattcaaaatggttgaaagaaccatactttgttcaagccgtggattacggagattatatctacttcttcttcagggaaatagcagtggagtataacaccatgggaaaggtagttttcccaagagtggctcaggtttgtaagaatgatatgggaggatctcaaagagtcctggagaaacagtggacgtcgttcctgaaggcgcgcttgaactgctcagttcctggagactctcatttttatttcaacattctccaggcagttacagatgtgattcgtatcaacgggcgtgatgttgtcctggcaacgttttctacaccttataacagcatccctgggtctgcagtctgtgcctatgacatgcttgacattgccagtgtttttactgggagattcaaggaacagaagtctcctgattccacctggacaccagttcctgatgaacgagttcctaagcccaggccaggttgctgtgctggctcatcctccttagaaagatatgcaacctccaatgagttccctgatgataccctgaacttcatcaagacgcacccgctcatggatgaggcagtgccctccatcttcaacaggccatggttcctgagaacaatggtcagataccgccttaccaaaattgcagtggacacagctgctgggccatatcagaatcacactgtggtttttctgggatcagagaagggaatcatcttgaagtttttggccagaataggaaatagtggttttctaaatgacagccttttcctggaggagatgagtgtttacaactctgaaaaatgcagctatgatggagtcgaagacaaaaggatcatgggcatgcagctggacagagcaagcagctctctgtatgttgcgttctctacctgtgtgataaaggttccccttggccggtgtgaacgacatgggaagtgtaaaaaaacctgtattgcctccagagacccatattgtggatggataaaggaaggtggtgcctgcagccatttatcacccaacagcagactgacttttgagcaggacatagagcgtggcaatacagatggtctgggggactgtcacaattcctttgtggcactgaatgggcattccagttccctcttgcccagcacaaccacatcagattcgacggctcaagaggggtatgagtctaggggaggaatgctggactggaagcatctgcttgactcacctgacagcacagaccctttgggggcagtgtcttcccataatcaccaagacaagaagggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataa

SEQ ID NO: 179799 - DNA, 1678 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000503865
  CDS Start-End: 300-1529
aattgaagggaggaggacccttaggaaggaaagaaaaagagaatgtacttttcaggctaaggtttctgggttttaaaaccatcacttcagaaatcaaaatattttagcagaaaaacccccatgagaaagcttcaaggtctcggctgtgacaaagacaacatttcagtagaagtttaaggttgcgtgttgtgggcttgggaaggggtagagatctttatttcctttcattctaattctgtgccactgatacctgccagtaaaatacatgaaacatattccagaaagagttgatttagtagatgaaaaatgcgtctcccgagaccagagaaggagtgattcgggaaagttacctcaaaggccacgaccagctggttcccgtcaccctcttggccattgcagtcatcctggctttcgtcatgggggccgtcttctcgggcatcaccgtctactgcgtctgtgatcatcggcgcaaagacgtggctgtggtgcagcgcaaggagaaggagctcacccactcgcgccggggctccatgagcagcgtcaccaagctcagcggcctctttggggacactcaatccaaagacccaaagccggaggccatcctcacgccactcatgcacaacggcaagctcgccactcccggcaacacggccaagatgctcattaaagcagaccagcaccacctggacctgacggccctccccaccccagagtcaaccccaacgctgcagcagaagcggaagcccagccgcggcagccgcgagtgggagaggaaccagaacctcatcaatgcctgcacaaaggacatgccccccatgggctcccctgtgattcccacggacctgcccctgcgggcctcccccagccacatccccagcgtggtggtcctgcccatcacgcagcagggctaccagcatgagtacgtggaccagcccaaaatgagcgaggtggcccagatggcgctggaggaccaggccgccacactggagtataagaccatcaaggaacatctcagcagcaagagtcccaaccatggggtgaaccttgtggagaacctggacagcctgccccccaaagttccacagcgggaggcctccctgggtcccccgggagcctccctgtctcagaccggtctaagcaagcggctggaaatgcaccactcctcttcctacggggttgactataagaggagctaccccacgaactcgctcacgagaagccaccaggccaccactctcaaaagaaacaacactaactcctccaattcctctcacctctccagaaaccagagctttggcaggggagacaacccgccgcccgccccgcagagggtggactccatccaggtgcacagctcccagccatctggccaggccgtgactgtctcgaggcagcccagcctcaacgcctacaactcactgacaaggtcggggctgaagcgtacgccctcgctaaagccggacgtaccccccaaaccatcctttgctcccctttccacatccatgaagcccaatgatgcgtgtacataatcccagggggagggggtcaggtgtcgaaccagcaggcaaggcgaggtgcccgctcagctcagcaaggttctcaactgcctcgagtacccaccagaccaagaaggcctgcggcagagccgaggacgctgggtcctcctctctgggacaca

SEQ ID NO: 179800 - DNA, 538 bp, Homo sapiens
  Payload ID: 15431
  Gene Symbol: SEMA6A
  Gene Name: sema domain, transmembrane domain (TM), and cytoplasmic domain, (semaphorin) 6A
  ENST ID: ENST00000509665
  CDS Start-End: 197-538
aacaaataaggcaggaatgggctgtatctgctgttgaccatctcaacgcccaagcctgcctttcctggcttagggaggaggccctgttggggaactgagctttctccatagccagagatttttggttccagggcttcttgacatgaaactcccaaaagggtgaagtagagaaataaagtctccccgctgaactactatgaggtcagaagccttgctgctatatttcacactgctacactttgctggggctggtttcccagaagattctgagccaatcagtatttcgcatggcaactatacaaaacagtatccggtgtttgtgggccacaagccaggacggaacaccacacagaggcacaggctggacatccagatgattatgatcatgaacggaaccctctacattgctgctagggaccatatttatactgttgatatagacacatcacacacggaagaaatttattgtagcaaaaaactgacatggaaatctagacaggccgatgtagacacatgcagaatgaagggaaaacataag

SEQ ID NO: 179801 - DNA, 2034 bp, Homo sapiens
  Payload ID: 15432
  Gene Symbol: SEMA6B
  Gene Name: sema domain, transmembrane domain (TM), and cytoplasmic domain, (semaphorin) 6B
  Uniprot ID: Q9H3T3
  ENST ID: ENST00000586965
  CDS Start-End: 1-2034
atgcagaccccgcgagcgtcccctccccgcccggccctgctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttga

SEQ ID NO: 179802 - DNA, 3986 bp, Homo sapiens
  Payload ID: 15432
  Gene Symbol: SEMA6B
  Gene Name: sema domain, transmembrane domain (TM), and cytoplasmic domain, (semaphorin) 6B
  Uniprot ID: Q9H3T3
  ENST ID: ENST00000586582
  CDS Start-End: 312-2978
aaatcctggaagctcagggtcgtgaagaggaagtccagccgcgctatgcgaggtcttcctgtttttggagggggcaggcaccccagggccgattgtcgcgaatcaccttcacctctgggggctcagaatccctgagccagaaggccagggcagggctgggggatacccctgctgctcagacaggaaaatgggctcggagcttgcccaatacttcccagaaggacgaggctgctgaacttctcattcggggctccgggacctggactgtacccctttctggcgtcacctcctcctgtcgcctggccctcgccatgcagaccccgcgagcgtcccctccccgcccggccctgctgcttctgctgctgctactggggggcgcccacggcctctttcctgaggagccgccgccgcttagcgtggcccccagggactacctgaaccactatcccgtgtttgtgggcagcgggcccggacgcctgacccccgcagaaggtgctgacgacctcaacatccagcgagtcctgcgggtcaacaggacgctgttcattggggacagggacaacctctaccgcgtagagctggagccccccacgtccacggagctgcggtaccagaggaagctgacctggagatctaaccccagcgacataaacgtgtgtcggatgaagggcaaacaggagggcgagtgtcgaaacttcgtaaaggtgctgctccttcgggacgagtccacgctctttgtgtgcggttccaacgccttcaacccggtgtgcgccaactacagcatagacaccctgcagcccgtcggagacaacatcagcggtatggcccgctgcccgtacgaccccaagcacgccaatgttgccctcttctctgacgggatgctcttcacagctactgttaccgacttcctagccattgatgctgtcatctaccgcagcctcggggacaggcccaccctgcgcaccgtgaaacatgactccaagtggttcaaagagccttactttgtccatgcggtggagtggggcagccatgtctacttcttcttccgggagattgcgatggagtttaactacctggagaaggtggtggtgtcccgcgtggcccgagtgtgcaagaacgacgtgggaggctccccccgcgtgctggagaagcagtggacgtccttcctgaaggcgcggctcaactgctctgtacccggagactcccatttctacttcaacgtgctgcaggctgtcacgggcgtggtcagcctcgggggccggcccgtggtcctggccgttttttccacgcccagcaacagcatccctggctcggctgtctgcgcctttgacctgacacaggtggcagctgtgtttgaaggccgcttccgagagcagaagtcccccgagtccatctggacgccggtgccggaggatcaggtgcctcgaccccggcccgggtgctgcgcagcccccgggatgcagtacaatgcctccagcgccttgccggatgacatcctcaactttgtcaagacccaccctctgatggacgaggcggtgccctcgctgggccatgcgccctggatcctgcggaccctgatgaggcaccagctgactcgagtggctgtggacgtgggagccggcccctggggcaaccagaccgttgtcttcctgggttctgaggcggggacggtcctcaagttcctcgtccggcccaatgccagcacctcagggacgtctgggctcagtgtcttcctggaggagtttgagacctaccggccggacaggtgtggacggcccggcggtggcgagacagggcagcggctgctgagcttggagctggacgcagcttcggggggcctgctggctgccttcccccgctgcgtggtccgagtgcctgtggctcgctgccagcagtactcggggtgtatgaagaactgtatcggcagtcaggacccctactgcgggtgggcccccgacggctcctgcatcttcctcagcccgggcaccagagccgcctttgagcaggacgtgtccggggccagcacctcaggcttaggggactgcacaggactcctgcgggccagcctctccgaggaccgcgcggggctggtgtcggtgaacctgctggtaacgtcgtcggtggcggccttcgtggtgggagccgtggtgtccggcttcagcgtgggctggttcgtgggcctccgtgagcggcgggagctggcccggcgcaaggacaaggaggccatcctggcgcacggggcgggcgaggcggtgctgagcgtcagccgcctgggcgagcgcagggcgcagggtcccgggggccggggcggaggcggtggcggtggcgccggggttcccccggaggccctgctggcgcccctgatgcagaacggctgggccaaggccacgctgctgcagggcgggccccacgacctggactcggggctgctgcccacgcccgagcagacgccgctgccgcagaagcgcctgcccactccgcacccgcacccccacgccctgggcccccgcgcctgggaccacggccaccccctgctcccggcctccgcttcatcctccctcctgctgctggcgcccgcccgggcccccgagcagccccccgcgcctggggagccgacccccgacggccgcctctatgctgcccggcccggccgcgcctcccacggcgacttcccgctcaccccccacgccagcccggaccgccggcgggtggtgtccgcgcccacgggccccttggacccagcctcagccgccgatggcctcccgcggccctggagcccgcccccgacgggcagcctgaggaggccactgggcccccacgcccctccggccgccaccctgcgccgcacccacacgttcaacagcggcgaggcccggcctggggaccgccaccgcggctgccacgcccggccgggcacagacttggcccacctcctcccctatgggggggcggacaggactgcgccccccgtgccctaggccgggggccccccgatgccttggcagtgccagccacgggaaccaggagcgagagacggtgccagaacgccggggcccggggcaactccgagtgggtgctcaagtcccccccgcgacccacccgcggagtggggggccccctccgccacaaggaagcacaaccagctcgccctccccctacccggggccgcaggacgctgagacggtttgggggtgggtgggcgggaggactttgctatggatttgaggttgaccttatgcgcgtaggttttggttttttttgcagttttggtttcttttgcggttttctaaccaattgcacaactccgttctcggggtggcggcaggcaggggaggcttggacgccggtggggaatggggggccacagctgcagacctaagccctcccccacccctggaaaggtccctccccaacccaggcccctggcgtgtgtgggtgtgcgtgcgtgtgcgtgccgtgttcgtgtgcaaggggccggggaggtgggcgtgtgtgtgcgtgccagcgaaggctgctgtgggcgtgtgtgtcaagtgggccacgcgtgcagggtgtgtgtccacgagcgacgatcgtggtggccccagcggcctgggcgttggctgagccgacgctggggcttccagaaggcccgggggtctccgaggtgccggttaggagtttgaaccccccccactctgcagagggaagcggggacaatgccggggtttcaggcaggagacacgaggagggcctgcccggaagtcacatcggcagcagctgtctaaagggcttgggggcctggggggcggcgaaggtgggtggggcccctctgtaaatacggccccagggtggtgagagagtcccatgccacccgtccccttgtgacctcccccctctgacctccagctgaccatgcatgccacgtggctggctgggtcctctgccctctctggagtttgcctcccccagccccctccccatcaataaaactctgtttacaacca

SEQ ID NO: 179803 - DNA, 5262 bp, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENST ID: ENST00000341697
  CDS Start-End: 1693-4485
cgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagcaagtaccccgggcagggaaggggctgcggggaggcggggagggagcaggagggcgcggccggcggggggcaagcttctgaagcgctaggggaccagggaggtgtcggcgcccggtgtgcctggctgacggagagggtcaacgaaattggggtgcagggaggaaggagggacagtggccgagccccgtaactgtactggtgagagcagagtctgggcacctcgttcaattgggctttcgtcgagtcgcatcccgctggactgggaagcgcgaaaagggattatttgaggcgcgctccgtagagagcgtggaaaacctggccccttgctttcccagcaaggaaactagggctccgagacccacggagaactagaccctcctgacgcccctgaagggatgggaagagggacgcatcgttccggactttgtgtcacgggtgctcctctgtccttgtgcaagccggaatctgagcaccctctgaagggttggctcgtgcaaagaggcggcgaatggggccctcgagcaacatcggtcccagcgcctatctccttccttcagcccgctcggcccggggctttgttagactgaggtctcccaaggaggacatccgagctggcaactgcctcctgagcccacggtccccactgagcgccggcctcaggcccgccctcgtcggttctcagcctctggccctgtttccctggcctgggagacccgcctccgctccccaacccccgctcctatcccctcttcgtctgcgcctgcaggcccctccagcccctcctctcgctaacgtggctctgggacccggtcccggcccagactctgctaccggcccctcctcggagccccggatccggtgagggggagacaggtcgagcccctggccctaggcccacctcttttcgaggctttagacacctggattgtcctggttgggggttgggtgggaaggagggtaggtgctgagtgtggggctaagagctaagagtgggggaaatggcttggagaaaggaaagctccggttccacaggctccttggcgcgaccctgctccctctgaggaaggtggactggggcgggcgaccagcccaaaggcttcctgctattgtccccagcccagtctccccttctccatcccttccacagctctcctagactctggctgtgaccccagccattccccagaggtggcttcggggccaggagagagaagggctgtttcctcttcccagcaacgggaggatctggaaaggggagagtcggccaggtctctcccatgtgcttcagatggggtgtgtgaagcagctcggattcttccagggcagagtgatcttttctccaggccaggagttgaggagctgaccagatgctgcttcccagaaacagctacaagaagccctcttaaaggtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgtta

SEQ ID NO: 179804 - DNA, 3697 bp, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENST ID: ENST00000368912
  CDS Start-End: 130-2898
cgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatgtgcttccgggtcctggcccttcccctgggacccccagtcctcccagtgatgcccacccccggccccagtcttccactcttggagttcacactcggggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 179805 - DNA, 3817 bp, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENST ID: ENST00000368913
  CDS Start-End: 130-3018
cgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatgtgcttccgggtcctggcccttcccctgggacccccagtcctcccagtgatgcccacccccggccccagtcttccactcttggagttcacactcggggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 179806 - DNA, 3892 bp, Homo sapiens
  Payload ID: 15433
  Gene Symbol: SEMA6C
  Gene Name: sema domain, transmembrane domain (TM), and cytoplasmic domain, (semaphorin) 6C
  Uniprot ID: Q9H3T2
  ENST ID: ENST00000368914
  CDS Start-End: 301-3093
gttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgtgcaggagtagggggagctgccttgttctcctcttcccgagacctccctgatgatgtcctgaccttcatcaaggctcacccgctgctggaccccgctgtaccacctgtcacccatcagcctctactcactctcactagcagggccctactgacccaagtagctgtggatggcatggctggtccccacagtaacatcacagtcatgttccttggctccaatgatgggacagtgctgaaggtgctgaccccaggtgggcgatccgggggacctgagcccatcctcctggaagagattgatgcctacagccctgcccggtgcagtgggaagcggacagcccaaacagcacgacggatcatagggctggagctggacactgagggtcacaggctttttgtggctttttctggctgtattgtctacctccctctcagccggtgtgcccggcatggggcctgtcagaggagctgtttggcttctcaggacccatactgtggatggcatagctccaggggctgtgtggatatcaggggatctggtgggactgatgtggatcaggctgggaaccaggaatccatggagcatggtgactgccaagatggagctactgggagtcagtctggccctggggattctgcttatggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcgagactccggggctcccgcgccctctctccctccgcagtttggcccggctccacggtgggggcccagagcccccgccgccctccaaggacggggacgcggtgcagacgccgcagctctacaccaccttcctgccgcctccggagggcgtgcccccgccggagctggcctgcctgcccacccccgagtccacgccggagctgccggtcaagcacctccgcgccgccggggacccctgggagtggaaccagaacaggaacaacgccaaggagggtccgggccgctcacggggcgggcacgcggcgggcgggcccgcgccccgcgtgctggtgaggccaccgccgcccggctgtcccgggcaggccgtggaagtcaccaccctggaggaactgctgcgctacctgcacggcccgcagccgcccagaaagggggccgagccccccgcccctttaacctcgcgggcgctcccgccggagcccgcccccgccctcttgggcggccccagccccaggccccacgagtgcgcctcgccgctgaggctggacgtgccccccgagggcaggtgcgcctctgcccccgcccggcccgcgctctccgcccccgctccccggctgggcgtcggcggaggccggaggttgcctttctccggccaccgggccccccctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaa

SEQ ID NO: 179807 - DNA, 1950 bp, Homo sapiens
  Payload ID: 15433
  Gene Symbol: SEMA6C
  Gene Name: sema domain, transmembrane domain (TM), and cytoplasmic domain, (semaphorin) 6C
  ENST ID: ENST00000613223
  CDS Start-End: 337-1950
actggggccgagcccagagccccgggcggtcgcattgttttcctccgcggatccgcggctggacttggacccagggctctcccgacagcgccctggaacccaaattcaagcaccatccaattcggacgctcatcgcatctcgcctgagcacaaccacggattgcgaactcagcgcagcgcgtggccgctggccgcccgcggcgatctcgatcccgctgacccgaatcctggagtcagaggtttcctatccccctcaagcccccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccagccctgcccgctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaa

SEQ ID NO: 179808 - DNA, 1918 bp, Homo sapiens
  Payload ID: 15433
  Gene Symbol: SEMA6C
  Gene Name: sema domain, transmembrane domain (TM), and cytoplasmic domain, (semaphorin) 6C
  ENST ID: ENST00000621728
  CDS Start-End: 77-1690
cccacaggagtcaccaacccagggccggcttatgggtgagggggcaccccctggggcctgagctgccccgcacaggatgccccgtgccccccacttcatgcccttgctgctactgctgctgctgctctcacttccccatactcaggccgcctttccccaggaccccctccctctgttgatctctgaccttcaaggtacttccccattatcctggtttcggggcctggaggatgatgctgtggctgcagaacttgggctggactttcagagattcctgaccttgaaccggaccttgctagtggctgcccgggatcacgttttctccttcgatcttcaagccgaagaagaaggggaggggctggtgcccaacaagtatctaacatggagaagccaagatgtggagaactgtgctgtacggggaaagctgacggatgagtgctacaactatattcgtgttcttgttccctgggactcccagacgctccttgcctgtggaacgaactcattcagccctgtgtgccgcagctatgggataacttcgctgcagcaggagggtgaggaactgagtgggcaggctcgatgcccctttgatgccacccagtccaacgtggccatctttgcagagggcagcctgtactcagccacagctgcggatttccaggccagtgatgctgtagtttacagaagccttgggccccagcccccactccgctccgccaagtatgactccaagtggctccgagagccacactttgtccaggccttggagcatggagaccatgtctacttcttcttccgcgaggtctctgtggaggatgctcggctggggagggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaatagcatccctggctctgccgtctgcgccttctacctggatgagattgagcgtgggtttgagggcaagttcaaggagcagaggagtctggatggggcctggactcctgtgtctgaggacagagttccctcacccaggccaggatcctgccctgctcactcgagtcccctcgggaggtccctccaggtactccgggggtcccgggaagcacctcctgtacctgggccggcccgagggctaccggggccgcgccctgaaaagggtggacgtcgagaagccccagttgtccctgaagcctcccctcgtcgggccctcctcccgccaggccgtcccgaacggcggccgtttcaacttttaaagggagcggcccacggcctccagcgtggggagcgcccgagtcctctcggccacgagctggacgctcttcaggacgtttcaccgccccctcgccccgcacctccagccttcccgactcgcagagtctcccgaggccccttttcgcctcgggtttatttattgactgtctttccccctgtcctcgacagaagagtgggaggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggcc

SEQ ID NO: 179809 - DNA, 6099 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000316364
  CDS Start-End: 440-3661
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 179810 - DNA, 5931 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000354744
  CDS Start-End: 440-3493
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 179811 - DNA, 5908 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000355997
  CDS Start-End: 440-2233
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattat

SEQ ID NO: 179812 - DNA, 5913 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000358066
  CDS Start-End: 440-3475
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 179813 - DNA, 2318 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000389425
  CDS Start-End: 468-1898
atccccatccccggcccaggcccggagggcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtaggtatatgttacgagaacgcccttcagcactgctcaaaaattttcggcatgtatttcatctagtcatgtccttttggtcctctaaattagcagtggtttggcataatagtgttttgtgttttttttctcattgaaataaatcttgggtttgtttttttcccgagcctgctagggcgaggggggtgaatggttgatgagtttaaaaataatgcagcccttgtttttcacctgtagaatatgagaacattttaacagcacctctcttatcttgcagatatattccaagatgctacatgcagcagacagctgtgagcttgcatacacacacacacaaatatacatgcacatacatacacagaatgcagtactagttaagtatttccttcctatctttaataagtaagagaatatttagaccatt

SEQ ID NO: 179814 - DNA, 5874 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000389428
  CDS Start-End: 440-3436
gcggccgcttcccaccgtccctctccccttactggcagagcgcgctgcgggcggactcccgggcccggagcagcccaccggccaccccaccgcccacccggctcccggtgtctcctcccggccgctctacccagcaactttccgtgctttgttccccgactggaaatgctttacggaagcgtcttggacagggtctccgccaggcgacaagagctcggtgctgagatgtgttacgttctcatctccccatcaattatggatggaaacaaataaggaagagtcaattttgctgagccccttctccggcaacgagaggcgttctgcagccgggagggagccgccgctcgcgccggcagccgctggcaggggcatggtgaggaggaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcattata

SEQ ID NO: 179815 - DNA, 5712 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000537942
  CDS Start-End: 242-3277
caggatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatt

SEQ ID NO: 179816 - DNA, 3754 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000536845
  CDS Start-End: 385-3606
cgtccgtgcccgggggtgggacccgcgccgggagctgccgagtgcgtggagggagccaggctccggctcgcctgatggattgacttggagatggatcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcag

SEQ ID NO: 179817 - DNA, 6028 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000558014
  CDS Start-End: 557-3592
gtaaccggtggaagtgtcaaagaggaaggagtggagggctgctgaggtgacagggtgtggtctgtgagggagcggacgaacccggagaagagagcagagagacccaccaggactaggaggcagcggggagcgtgcctgcgtcgctcggagcggtgacagcaaggagcgcagcgcggaggccgggcggcaaggggagtttccagtcctcgataagtggagtccctgctctgcgctgcgccagcgccttccgcctgggcccgcggtgctagacacctgccgagtccgaagcgggagtcaggctgagccttcggcccccaagatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgctgctgttaaccgaagacttctttgctttccataaccacagtgctgaaggatatgaacaagacacagaattcggcaacacagctcatctaggggactgccatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaacaaaaatagaagacaaaagaaagacatatgaaaggaattgtaattggcttaacagaaacagtctgtaaaaacctaacagtggtgcaatcatgttgtctgtgttgtgttatgtgagaattttctcctaagtcatgcaggtaatgacaatatactgtaaataccacatgtgagtttacctgaatctgtgcattttgtgccttattcatgagaatgatagaagtactaaaatctgtcaagtgttttcagtatagcacattatttactgagtgccagttgtaaatgtttttcaaccagcacctaaaaagactcttttcaaaaaatcacagaaacaacctaggacaattatttgttacataatccgacctcatagcagcattacattctttgccgtgataaacattccactcctgctttcctaaggatgaaacagtgataatgtgaactcaaatgaggtttcctgggtaatgtgacacctgcagaaactatagagcgtcatttatacgtagtttggcagaaaccacttacggctgatgatgcgcaaccctgctgactgtttcagttaatatgctgcacaccacacacttgtttagtgaaccaaatctagaaagtaccaaggcagaggtatgctcctgctgtaatcaggcaaatgagttcaactggatttcttttgacaatactgttggtacctattacttgggggaggacatgttgcagaagaccagatcatttttatacagaatgtgaaatactgatacagttattcttttttttaaagaacattgttttataaagaacgtgatttccagtgatctctggaagcgctaaagctaaaatttctgttcttgaaacacttcagctttgcaactaaaatattacagattaataataaattaaaccaaccaatgataaacactactcagtccaccaacaacaaacgtgtttgaattcaccttaccaatattaatcccagcgtgtgtaaaacagaacagtaactctatgtgaccccagataacattttgtaacattgtgcttccttgtagtttgtaatgtgagttcaatcagtatttatgttgaaatttctaacattaaatctagtctctatcctgttaatttaatttttaaatgctttatccatttgtgcaaaggtaaacgcagattgtatcttttttaatggtacggcataaaaagtaaccctcaagtgaagtgtctctatactgttttatagagtactttaacatgaatagataccttgtaaacttgtattgtggatgtgtaaataatatgtactttgggtttttaacaccgcatgtaaagtcaaaataaaatatacaaatcatta

SEQ ID NO: 179818 - DNA, 545 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000559184
  CDS Start-End: 480-545
gcatgctaacattcatggaggcagacatgtgtacccagaatcagagggagccggttatcctcagttggagatcccaaaagacttctgcatacagttcctttcgttggatggagacactgtaagaaccacggagtgttaaacttggggcttgggaatcagagtccatccttgaatttcacaaaagaaacgaccgaaatcaaaagaaggcaagatacagctgttcgcatttgcagacctgtatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggtagctcagtggcatttctgagcaggggccaccctgacttcaccttggcccaccatgagggtcttcctgctttgtgcctacatactgctgctgatggtttcccagttgagggcagtcagc

SEQ ID NO: 179819 - DNA, 479 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000560636
  CDS Start-End: 152-155
aggactgggtttggagagctgctggatagctgaacacgtggaggttcctggaaggcggcacacccagagagagcatggtagctccatgctgcttcccccatacctcaccctacacatctcttcatctgtatcctttataataatccactaaatgatctccaacctgagcatatgccagttgacatgggaacactgaggccagcaatttaaggatttcacatttgcttgcagtgaatgcgtaatcctggatctcttgttcgcaaatcgacagcctgaagccctctggaagcccaagactgctggaggtttttgaccagacaagccaacctttttcaaggaacttccaatcctgctttagaacttactccttcaggaaagcaactctcactgaagtgtgggagcggagcagagaaaagactaggtagctcagtggcatttctgagcaggggccaccctgacttcaccttggcccaccatga

SEQ ID NO: 179820 - DNA, 580 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000559064
  CDS Start-End: 1-163
gctgttaaccgaagacttctttgctttccataaccacagtgctgaaggatatgaacaagacacagaattcggcaacacagctcatctaggggactgccatgaaattttgcctacttcaactacaccagattacaaaatatttggcggtccaacatctggttagttttttttaatttttttgaattaacaaccttttctttccttcagttcagcattttcagccccttctcccctccttttgcgcagtttggcagcccttcatttttccgctttgactcatattcccactgatggtaccaaaagacttttcttactgagcacttcacccttgtttatagcatgttaacacttcatcattgaccaagccacatcctttaagaaaattcaaatgggctaacatagactgcattccagctgcacgcacgcccacccaagctttcttctttctcacctctttgcattgtgaatgtttcttctggtcatctgtatttaatggatggcggaatttcattattttccccatctctcctcacctttcctatgacctagtaaacaaatacacatttcccataaatgtgta

SEQ ID NO: 179821 - DNA, 588 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000561133
  CDS Start-End: 145-588
aaggcagaacttcacggaacaactgcgcccgcagctctcctgggctgcagtgatttgtcctctgggttctggaggaaagctctgaaagaagtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactac

SEQ ID NO: 179822 - DNA, 4419 bp, Homo sapiens
  Payload ID: 15434
  Gene Symbol: SEMA6D
  Gene Name: sema domain, transmembrane domain (TM), and cytoplasmic domain, (semaphorin) 6D
  Uniprot ID: Q8NFY4
  ENST ID: ENST00000558816
  CDS Start-End: 291-2084
atcgaattacaccatttgccgtgcatcggtttgttttgctcctgctctgtcccgctgctgctgctgctgctgcaaggggtggtggcgagtttcaggattctatcaaggaagccaagacctaaggagacagagggatatctatttttacaatatttttctttattttctttcttccttgcgcgtggcaagcttttttttttctttttcttttttcttaccagcctccccccaatgaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaagagccacactttcttcatgccatagaatatggaaactatgtctatttcttctttcgagaaatcgctgtcgaacataataatttaggcaaggctgtgtattcccgcgtggcccgcatatgtaaaaacgacatgggtggttcccagcgggtcctggagaaacactggacttcatttctaaaggctcggctgaactgttctgtccctggagattcgtttttctactttgatgttctgcagtctattacagacataatacaaatcaatggcatccccactgtggtcggggtgtttaccacgcagctcaatagcatccctggttctgctgtctgtgcatttagcatggatgacattgaaaaagtattcaaaggacggtttaaggaacagaaaactccagattctgtttggacagcagttcccgaagacaaagtgccaaagccaaggcctggctgttgtgcaaaacacggccttgccgaagcttataaaacctccatcgatttcccggatgaaactctgtcattcatcaaatctcatcccctgatggactctgccgttccacccattgccgatgagccctggttcacaaagactcgggtcaggtacagactgacggccatctcagtggaccattcagccggaccctaccagaactacacagtcatctttgttggctctgaagctggcatggtacttaaagttctggcaaagaccagtcctttctctttgaacgacagcgtattactggaagagattgaagcctacaaccatgcaaagtgcagtgctgagaatgaggaagacaaaaaggtcatctcattacagttggataaagatcaccacgctttatatgtggcgttctctagctgcattatccgcatccccctcagtcgctgtgagcgttatggatcatgtaaaaagtcttgtattgcatctcgtgacccgtattgtggctggttaagccagggatcctgtggtagagtgaccccagggatgcttgctgaaggatatgaacaagacacagaattcggcaacacagctcatctaggggactgccatgacatggaggtatcttcatcttctgttaccacaatggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattctcctaaactgtatagtaacctgctaaccagtcggaaagagctaccacccaatggagatactaaatccatggtaatggaccatcgagggcaacctccagagttggctgctcttcctactcctgagtctacacccgtgcttcaccagaagaccctgcaggccatgaagagccactcagaaaaggcccatggccatggagcttcaaggaaagaaacccctcagttttttccgtctagtccgccacctcattccccattaagtcatgggcatatccccagtgccattgttcttccaaatgctacccatgactacaacacgtctttctcaaactccaatgctcacaaagctgaaaagaagcttcaaaacattgatcaccctctcacaaagtcatccagtaagagagatcaccggcgttctgttgattccagaaataccctcaatgatctcctgaagcatctgaatgacccaaatagtaaccccaaagccatcatgggagacatccagatggcacaccagaacttaatgctggatcccatgggatcgatgtctgaggtcccacctaaagtccctaaccgggaggcatcgctatactcccctccttcaactctccccagaaatagcccaaccaagcgagtggatgtccccaccactcctggagtcccaatgacttctctggaaagacaaagaggttatcacaaaaattcctcccagaggcactctatatctgctatgcctaaaaacttaaactcaccaaatggtgttttgttatccagacagcctagtatgaaccgtggaggatatatgcccacccccactggggcgaaggtggactatattcagggaacaccagtgagtgttcatctgcagccttccctctccagacagagcagctacaccagtaatggcactcttcctaggacgggactaaagaggacgccgtccttaaaacctgacgtgccaccaaagccttcctttgttcctcaaaccccatctgtcagaccactgaacaaatacacatactaggcctcaagtgtgctattcccatgtggctttatcctgtccgtgttgttgagaggatgatgttgtaagggtaccttaaaacaagagactcgcttgtattttaagagaaccaagtggccaaagaaactctttctaactttggcaacatcagaacttgccacatgtagctactgcagcaaggcttctgtgtacttgcctgaaaacaaaggaaggtgctggtcattccatttcttttgtttgaagctaaagagatgtgtagctcacaggggctaccttaccagtataaagagctgataacagtactcagaagaatctgtgaacaaatacttgaaaatgggttcaatgtagactgccattatgtgtggtcttcccattaaatgtgaacattttaatatgtatgcattcaccttgcctcttgcacaaatgtcaaaaaaaagatggtaatatctcaaagaaatgaacttgtagattaccaagcagtttgctaaaaattcaatctttgacccaagctgtagcatttttttttcatgtgtggcatctttttcatgccaccaacaaacttgttgtgtgtgtgcgtgtgtgtgtgtgtgtgtgtgtgtgtgtgtgtgttctgtacccactaggatttgtttaggtgcccattgcatctttttgtgctatggagttgtttacattaagcatgaccgaacgagagacaatactatttcccacaggagtccattgggttcagctttgaaagaggaatagaatcgaggctcctttgaccatcaaaatgatgaactttacttatgtggtacccaatgccagaatgtaagagttgcaagtgattttgtgctgctattcattaaaacttgtattccagtcttgccagcttaaggagatcaagatattaagaggtatccttgatttattttccagtattcagtagtaaaattttcctgtccactgtgaatcaaagcctgagtcactctatttaaccttggacacactaataaggttttattttgattgtgttcgtttccccccccccaatagtaaaatttctcctcctttaactcctcctaccccccaaggtaagaaacaaaaaacaaacaaacaaa

SEQ ID NO: 179823 - DNA, 592 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000560006
  CDS Start-End: 1-592
gttaaccgaagacttctttgctttccataaccacagtgctgaaggatatgaacaagacacagaattcggcaacacagctcatctaggggactgccatgaaattttgcctacttcaactacaccagattacaaaatatttggcggtccaacatctgacatggaggtatcttcatcttctgttaccacaatggcaagtatcccagaaatcacacctaaagtgattgatacctggagacctaaactgacaagctctcggaaatttgtagttcaagatgatccaaacacttctgattttactgatcctttatcgggtatcccaaagggtgtacgatgggaagtccagtctggagagtccaaccagatggtccacatgaatgtcctcatcacctgtgtctttgctgcttttgttttgggggcattcattgcaggtgtggcagtatactgctatcgagacatgtttgttcggaaaaacagaaagatccataaagatgcagagtccgcccagtcatgcacagactccagtggaagttttgccaaactgaatggtctctttgacagccctgtcaaggaataccaacagaatattgattct

SEQ ID NO: 179824 - DNA, 734 bp, Homo sapiens
  Payload ID: 15434
  Gene Symbol: SEMA6D
  Gene Name: sema domain, transmembrane domain (TM), and cytoplasmic domain, (semaphorin) 6D
  ENST ID: ENST00000559196
  CDS Start-End: 77-734
ccaaactgcttctgttttccaggtagctcagtggcatttctgagcaggggccaccctgacttcaccttggcccaccatgagggtcttcctgctttgtgcctacatactgctgctgatggtttcccagttgagggcagtcagctttcctgaagatgatgaaccccttaatactgtcgactatcactattcaaggcaatatccggtttttagaggacgcccttcaggcaatgaatcgcagcacaggctggactttcagctgatgttgaaaattcgagacacactttatattgctggcagggatcaagtttatacagtaaacttaaatgaaatgcccaaaacagaagtaatacccaacaagaaactgacatggcgatcaagacaacaggatcgagaaaactgtgctatgaaaggcaagcataaagatgaatgccacaactttatcaaagtatttgttccaagaaacgatgagatggtttttgtttgtggtaccaatgcattcaatcccatgtgtagatactacaggttgagtaccttagaatatgatggggaagaaattagtggcctggcaagatgcccatttgatgccagacaaaccaatgttgccctctttgctgatgggaagctgtattctgccacagtggctgacttcttggccagcgatgccgttatttatcgaagcatgggtgatggatctgcccttcgcacaataaaatatgattccaaatggataaaag

SEQ ID NO: 179825 - DNA, 3885 bp, Homo sapiens
  Payload ID: 15435
  Gene Symbol: SEMA7A
  Gene Name: semaphorin 7A, GPI membrane anchor (John Milton Hagen blood group)
  Uniprot ID: O75326
  ENST ID: ENST00000261918
  CDS Start-End: 550-2550
aatttccagtgttctcccaggcaaagcaacagcgggtccctgagtgctccccacatatcatcgttgtgcctgctggtaggctcagcagggagccgtgtccacttaggcgaacgcatcctccgaggaccatagtcctcagggtgcgaaccacttagctggccatagcaaggttgttgggtgttggactcctctgcgcccttggagagaggtcctccacgacttctacgccaatctttttacggggtgcggggagtggaactgaggcccagagaggggatagggcctgccgcccctggcagaagaccacaagtctggcttgtccgcagctgggctttccccgtagagttgcccgggagagggtggcgaaggttcccccagcagttccgctctcgctcaggaaagccagtgaggcgagaaaaggctgcgaggggcggggggaggggcggggtggggtcagcgctggctccgcctcctggcgcttgggtctgcctgcggccgggcgctggctcagtctcggctgattgccgctgtcgctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattta

SEQ ID NO: 179826 - DNA, 2304 bp, Homo sapiens
  Payload ID: 15435
  Gene Symbol: SEMA7A
  Gene Name: semaphorin 7A, GPI membrane anchor (John Milton Hagen blood group)
  Uniprot ID: O75326
  ENST ID: ENST00000543145
  CDS Start-End: 38-1996
ctcggctgattgccgctgtcgctcccggggccacgggatgacgcctcctccgcccggacgtgccgcccccagcgcaccgcgcgcccgcgtccctggcccgccggctcggttggggcttccgctgcggctgcggctgctgctgctgctctgggcggccgccgcctccgcccagggccacctaaggagcggaccccgcatcttcgccgtctggaaaggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgct

SEQ ID NO: 179827 - DNA, 3228 bp, Homo sapiens
  Payload ID: 15435
  Gene Symbol: SEMA7A
  Gene Name: semaphorin 7A, GPI membrane anchor (John Milton Hagen blood group)
  ENST ID: ENST00000542748
  CDS Start-End: 389-1894
agtgcgtgcgcgcagctctgcgggtcccgggctgtccccgcgctgtccccgcgtggagcgtgtgggtttgggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgagaggacaatcctgacaagaatcctgaggctcctctcaatgtgtcccgtgtggcccagttgtgcaggggggaccagggtggggaaagttcactgtcagtctccaagtggaacacttttctgaaagccatgctggtatgcagtgatgctgccaccaacaagaacttcaacaggctgcaagacgtcttcctgctccctgaccccagcggccagtggagggacaccagggtctatggtgttttctccaacccctggaactactcagccgtctgtgtgtattccctcggtgacattgacaaggtcttccgtacctcctcactcaagggctaccactcaagccttcccaacccgcggcctggcaagtgcctcccagaccagcagccgatacccacagagaccttccaggtggctgaccgtcacccagaggtggcgcagagggtggagcccatggggcctctgaagacgccattgttccactctaaataccactaccagaaagtggccgtccaccgcatgcaagccagccacggggagacctttcatgtgctttacctaactacagacaggggcactatccacaaggtggtggaaccgggggagcaggagcacagcttcgccttcaacatcatggagatccagcccttccgccgcgcggctgccatccagaccatgtcgctggatgctgagcggaggaagctgtatgtgagctcccagtgggaggtgagccaggtgcccctggacctgtgtgaggtctatggcgggggctgccacggttgcctcatgtcccgagacccctactgcggctgggaccaaggccgctgcatctccatctacagctccgaacggtcagtgctgcaatccattaatccagccgagccacacaaggagtgtcccaaccccaaaccagacaaggccccactgcagaaggtttccctggccccaaactctcgctactacctgagctgccccatggaatcccgccacgccacctactcatggcgccacaaggagaacgtggagcagagctgcgaacctggtcaccagagccccaactgcatcctgttcatcgagaacctcacggcgcagcagtacggccactacttctgcgaggcccaggagggctcctacttccgcgaggctcagcactggcagctgctgcccgaggacggcatcatggccgagcacctgctgggtcatgcctgtgccctggccgcctccctctggctgggggtgctgcccacactcactcttggcttgctggtccactagggcctcccgaggctgggcatgcctcaggcttctgcagcccagggcactagaacgtctcacactcagagccggctggcccgggagctccttgcctgccacttcttccaggggacagaataacccagtggaggatgccaggcctggagacgtccagccgcaggcggctgctgggccccaggtggcgcacggatggtgaggggctgagaatgagggcaccgactgtgaagctggggcatcgatgacccaagactttatcttctggaaaatatttttcagactcctcaaacttgactaaatgcagcgatgctcccagcccaagagcccatgggtcggggagtgggtttggataggagagctgggactccatctcgaccctggggctgaggcctgagtccttctggactcttggtacccacattgcctccttcccctccctctctcatggctgggtggctggtgttcctgaagacccagggctaccctctgtccagccctgtcctctgcagctccctctctggtcctgggtcccacaggacagccgccttgcatgtttattgaaggatgtttgctttccggacggaaggacggaaaaagctctatttttatgttaggcttatttcatgtatagctacttccgactgcatctgtatgaaaataccaaaactacatgcgggggggtgggtgggaaagggaggggctgggaagggatgggttggggagcgggggtgatcccagtctgaggctcccggggatgagataagagtctggagacgggcatgggttcttggagagtggcatgagctggctctgccctgggagcccggtctgagggggacgttgttggagcccctagtgttgggggtggttatgggagggggtggggtgagggaaacgggagaatgaaggagaaaactgagccctagtttcaccgtgttcatttggaaggacgagccgggtcctcagggggaggttccaggactctgcccttggcgttgagggttggggggcggggggcctcctcccttcctctcagcccccttccccaggggctgtgcttccatgctcctagcctcccaccttcgctcaggacatgttataacttaggctaaactgtgaaaattccggtggggatggcctgggccgagctctccaggcaggcggccctgcccccagccctgtccatccatttcaggggggagctgggcccttctccggctgtgtctggccacccagggcagtggctggggccagtggccttccagctttggcccctgcacctcttctcaatgcactttaataatgtaacatattactaataaacaagctatttattt

SEQ ID NO: 179828 - DNA, 674 bp, Homo sapiens
  Payload ID: 15435
  Gene Symbol: SEMA7A
  Gene Name: semaphorin 7A, GPI membrane anchor (John Milton Hagen blood group)
  ENST ID: ENST00000567345
  CDS Start-End: 433-674
agacgctgcgcggggcgggtgcggagtgtgctgcacccggagggagtgcgtgcgcgcagctctgcgggtcccgggctgtccccgcgctgtccccgcgtggagcgtgtgggtttgggccatgtagggcaggaccgggtggactttggccagactgagccgcacacggtgcttttccacgagccaggcagctcctctgtgtgggtgggaggacgtggcaaggtctacctctttgacttccccgagggcaagaacgcatctgtgcgcacggtgaatatcggctccacaaaggggtcctgtctggataagcgggactgcgagaactacatcactctcctggagaggcggagtgaggggctgctggcctgtggcaccaacgcccggcaccccagctgctggaacctggtgaatggcactgtggtgccacttggcgagatgagaggctacgcccccttcagcccggacgagaactccctggttctgtttgaaggggacgaggtgtattccaccatccggaagcaggaatacaatgggaagatccctcggttccgccgcatccggggcgagagtgagctgtacaccagtgatactgtcatgcagaacccacagttcatcaaagccaccatcgtgcaccaagaccaggcttacgatgacaagatctactacttcttccgaga

SEQ ID NO: 179829 - DNA, 1662 bp, Homo sapiens
  Payload ID: 15436
  Gene Symbol: SEMG1
  Gene Name: semenogelin I
  Uniprot ID: P04279
  ENST ID: ENST00000372781
  CDS Start-End: 58-1446
aaggaagatataaatgacaaggtcggctcagctctcagacaaggttttccaagcaagatgaagcccaacatcatctttgtactttccctgctcctcatcttggagaagcaagcagctgtgatgggacaaaaaggtggatcaaaaggccgattaccaagtgaattttcccaatttccacacggacaaaagggccagcactattctggacaaaaaggcaagcaacaaactgaatccaaaggcagtttttctattcaatacacatatcatgtagatgccaatgatcatgaccagtcccgaaaaagtcagcaatatgatttgaatgccctacataagacgacaaaatcacaacgacatctaggtggaagtcaacaactgctccataataaacaagaaggcagagaccatgataaatcaaaaggtcattttcacagggtagttatacaccataaaggaggcaaagctcatcgtgggacacaaaatccttctcaagatcaggggaatagcccatctggaaagggaatatccagtcaatattcaaacacagaagaaaggctgtgggttcatggactaagtaaagaacaaacttccgtctctggtgcacaaaaaggtagaaaacaaggcggatcccaaagcagttatgttctccaaactgaagagctagtagctaacaaacaacaacgtgagactaaaaattctcatcaaaataaagggcattaccaaaatgtggttgaagtgagagaggaacattcaagtaaagtacaaacctcactctgtcctgcgcaccaagacaaactccaacatggatccaaagacattttttctacccaagatgagctcctagtatataacaagaatcaacaccagacaaaaaatctcaatcaagatcaacagcatggccgaaaggcaaataaaatatcataccaatcttcaagtacagaagaaagacgactccactatggagaaaatggtgtgcagaaagatgtatcccaaagcagtatttatagccaaactgaagagaaagcacagggcaagtctcaaaaacagataacaattcccagtcaagagcaagagcatagccaaaaggcaaataaaatatcataccaatcttcaagtacggaagaaagacgactccactatggagaaaatggtgtgcagaaagatgtatcccaacgcagtatttatagccaaactgaaaagctagtagcaggcaagtctcaaatccaggcaccaaatcctaagcaagagccatggcatggtgaaaatgcaaaaggagagtctggccaatctacaaatagagaacaagacctactcagtcatgaacaaaaaggcagacaccaacatggatctcatgggggattggatattgtaattatagagcaggaagatgacagtgatcgtcatttggcacaacatcttaacaacgaccgaaacccattatttacataaacctaccattcggtaaccatgtgaaaggatggaccaatatcaaggtgtcagttgacctcagtgaattctgtgatgtttctgagatgcagactcccgtgtagtttcagattcttggtccatggatgacaccacctgcccatgcttccttgaattaggctttcctaacctgaagcgccttcaaacttccaataaagagatcattttctgcttcatctg

SEQ ID NO: 179830 - DNA, 2051 bp, Homo sapiens
  Payload ID: 15437
  Gene Symbol: SEMG2
  Gene Name: semenogelin II
  Uniprot ID: Q02383
  ENST ID: ENST00000372769
  CDS Start-End: 91-1839
gacatttcagctccacccatagcacacccactcaaggaacatataaatgaagagatccgctcagttctcagacaagatttttcaagcaagatgaagtccatcatcctctttgtcctttccctgctccttatcttggagaagcaagcagctgtgatgggacaaaaaggtggatcaaaaggccaattgccaagcggatcttcccaatttccacatggacaaaagggccagcactattttggacaaaaagaccaacaacatactaaatccaaaggcagtttttctattcaacacacatatcatgtagacatcaatgatcatgactggacccgaaaaagtcagcaatatgatttgaatgccctacataaggcgacaaaatcaaaacaacacctaggtggaagtcaacaactgctcaattataaacaagaaggcagagaccatgataaatcaaaaggtcattttcacatgatagttatacatcataaaggaggccaagctcatcatgggacacaaaatccttctcaagatcaggggaatagcccatctggaaagggattatccagtcaatgttcaaacacagaaaaaaggctatgggttcatggactaagtaaagaacaagcttcagcctctggtgcacaaaaaggtagaacacaaggtggatcccaaagcagttatgttctccaaactgaagaactagtagttaacaaacaacaacgtgagactaaaaattctcatcaaaataaagggcattaccaaaatgtggttgacgtgagagaggaacattcaagtaaactacaaacttcactccatcctgcacatcaagacagactccaacatggacccaaagacatttttactacccaagatgagctcctagtatataacaagaatcaacaccagacaaaaaatctcagtcaagatcaagagcatggccggaaggcacataaaatatcatacccgtcttcacgtacagaagaaagacaacttcaccatggagaaaagagtgtacagaaagatgtatccaaaggcagcatttctatccaaactgaagagaaaatacatggcaagtctcaaaaccaggtaacaattcatagtcaagatcaagagcatggccataaggaaaataaaatatcataccaatcttcaagtacagaagaaagacatctcaactgtggagaaaagggcatccagaaaggtgtatccaaaggcagtatttcgatccaaactgaagagcaaatacatggcaagtctcaaaaccaggtaagaattcctagtcaagctcaagagtatggccataaggaaaataaaatatcataccaatcttcgagtacagaagaaagacgtctcaacagtggagaaaaggatgtacagaaaggtgtatccaaaggcagtatttctatccaaactgaagagaaaatacatggcaagtctcaaaaccaggtaacaattcctagtcaagatcaagagcatggccataaggaaaataaaatgtcataccaatcttcaagtacagaagaaagacgactcaactatggaggaaagagcacgcagaaagatgtatcccaaagcagtatttctttccaaattgaaaagctagtagaaggcaagtctcaaatccagacaccaaatcctaatcaagatcaatggtctggccaaaatgcaaaaggaaagtctggtcaatctgcagatagcaaacaagacctactcagtcatgaacaaaaaggcagatacaaacaggaatccagtgagtcacataatattgtaattactgagcatgaggttgcccaagatgatcatttgacacaacaatataatgaagacagaaatccaatatctacatagccctgttgcttagcaaccacttgaaaagctggaccaatagcaaggtgtcacccgacctcagtgaagtctttgatgtttctgagaggcagactcccatgtggtcccagatccttggtccatggatgacaccaccttcccatgcttccttgcattaggctttctaaacccggagccccttcaaacttccaataaagggatcattttctgcttta

SEQ ID NO: 179831 - DNA, 11100 bp, Homo sapiens
  Payload ID: 15438
  Gene Symbol: SETX
  Gene Name: senataxin
  Uniprot ID: Q7Z333
  ENST ID: ENST00000224140
  CDS Start-End: 184-8217
cttccgctggtggcctagagcggggcccggtatggaggtgggctagaggccgacgccagccagagagcgaaatgttcttttggggccagagtctgggcatatatgaatgcaaatccgtgtttgttcacaactaagcccagctgagacgatcacttttctgtaggccatttgtccaggtacagaatgagcacatgttgttggtgtacgccaggtggtgcttccaccattgacttcctaaagcgctatgcttccaacactccgtccggtgaatttcaaacagccgacgaagacctctgctactgcttggagtgtgtggctgagtaccacaaagcaagagatgaattgccattcttgcatgaggttttatgggaattagaaaccttacgtctcataaatcactttgaaaaatccatgaaggcagaaattggagatgatgatgagttatatatagtagacaataatggagagatgccactgtttgacatcactgggcaagactttgaaaataagcttcgagttcctcttcttgaaatactgaaatatccttacttgcttctacatgaacgtgttaacgagttatgtgttgaagcactttgtcggatggaacaagccaattgctcctttcaggtgtttgataaacatccagggatctatttgtttttagtccatcccaatgaaatggttcggcgttgggctatcttgactgcaagaaacttggggaaagtggacagagatgattattatgacttacaagaagttttactttgcctttttaaagtcattgagttggggcttttagagagtccagacatttatacttcttctgtcctagagaagggtaaactgattcttctgccctcacacatgtatgatactaccaactacaaaagctattggttaggtatttgcatgttgctgaccattcttgaggaacaagccatggattccctgttgttgggctcagacaaacaaaatgattttatgcaatcgatacttcacactatggagagggaagcagatgatgatagtgtggatcctttctggccagcgttacactgttttatggtgattctggatcgccttggatctaaggtctggggtcaacttatggatcctattgtggcatttcaaaccattatcaacaacgcaagctacaatagagagatccgacatatacggaacagctctgtaaggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaatgaaagtgcaagacagtgtattgatcaaagcagataacactatagaaggtgacaataatgagcaaaattatataaaggatgtgaaactagaggaccatctcttagctgggtcatgcttaaagcagagtagtaaaaacatttttactgaaagagctgaagatcaaattaaaataagtacaaggaagcagaagtctgtaaaagagatctcttcatatacaccaaaggactgtacttcaagaaatggtccagaaaggggatgtgacagaggaataatagtatcaacacgtttgttgactgattctagcactgatgctttggaaaaagtgtccacatcgaatgaagatttctctttaaaggatgatgctcttgctaaaacctcaaaacgaaaaactaaggtacagaaagatgaaatctgtgcaaagttatcacatgtaataaagaagcaacacaggaagagtactttggtcgataatactatcaatttagatgaaaatttgactgtatctaacattgagagtttctattcaaggaaagatacaggagttcagaaaggagatggtttcatacacaatctttctttagaccctagtggtgttctggatgataagaatggagaacaaaaatctcaaaacaatgtattgccaaaagagaaacaattaaagaatgaagaattagttattttctctttccatgaaaacaattgtaaaatacaggaatttcatgttgatggtaaagaattgatcccttttacagaaatgaccaatgcttcagagaagaaatcatctccctttaaagatcttatgactgtacctgaatcaagagatgaggagatgagtaatagtaccagtgtgatttattctaacttgacaagagaacaggcccctgacatcagtcctaaatctgacaccttaacggattctcagatagacagagaccttcacaaattatctttactagctcaagccagtgttattacgttcccatccgattcacctcagaactcatcgcagctgcaaaggaaagtaaaagaagataaaagatgtttcacagctaaccaaaataatgttggagatacctcccgtggacaggttattattatttcagattctgatgatgatgatgatgaaagaatcctgagtcttgagaaactcactaaacaggacaaaatatgccttgagagggaacatccagagcagcacgtttcaacagttaatagtaaggaggaaaagaatccagtaaaggaagaaaagacagagactctttttcagtttgaggaatctgattctcagtgttttgagtttgaaagttcatctgaagtgttttcagtttggcaagatcatccagacgataataattcagttcaagatggtgagaaaaaatgtttggctcctatagccaatactacaaatggtcagggttgtacagattatgtatctgaagttgttaaaaaaggagcagagggcattgaagaacacacaagaccacggagtatttctgttgaagaattttgtgaaattgaagtaaaaaagcctaagagaaaacgatctgaaaaaccaatggctgaagatcctgtgaggccttcatcttctgtcagaaatgagggccagtctgatactaataagagagatcttgtgggaaatgattttaaaagtattgatagaaggacttcaactcccaattcacgtattcagagagccactacggtttcacaaaagaagtcttcaaagctttgtacttgtacagaacccatcaggaaagttccagtttctaagacccctaagaaaactcattcagatgccaaaaaaggacagaatagaagttcaaattacctaagttgtagaacaactcctgctatagtgccgccaaagaaatttcgtcagtgtcctgagccaacttcaacagctgagaaacttggcctgaaaaagggtcctcgtaaggcatatgagttgtcccagcggtctttggattatgtagctcaattacgtgatcatggcaaaactgttggagtagttgatacccgaaaaaagactaaattaatttctcctcagaacctgtctgtcagaaataataagaaacttctgactagtcaagaacttcagatgcaaaggcagatcagacccaaatcacaaaaaaatagacgaagactttctgattgtgaaagtacagatgttaaaagagcagggtcacatacagcacagaattctgacatatttgtaccagaatctgataggtcagattataattgtacaggaggaactgaggtacttgccaacagtaacagaaaacagttaataaaatgcatgccttctgaaccagaaaccataaaagcaaaacatgggtctccagcaactgatgatgcttgccctttgaaccagtgtgattctgtagtgttaaatggaacagtaccaacaaatgaagtaattgtctccacttcagaagaccctctgggtggaggtgatccaacagcacgtcatatagagatggcagctttgaaagaaggagagcctgactccagcagtgatgcagaggaagataacttatttttaacccaaaatgatcctgaagatatggatttatgttcacaaatggagaatgacaattataaactcattgaactaattcatggaaaagatacagttgaggttgaagaagattctgtaagtcggcctcagttggaatctttgagtggcacaaagtgtaagtacaaagattgtcttgaaaccacaaaaaaccagggtgaatactgcccaaaacactctgaagtgaaagcagcagatgaagatgtatttcgtaaacctggcttgcctcctcctgcatctaaacctttgagacctaccactaagatttttagctcaaagagtacttcacgaattgctggtctttctaaatctttggaaacttcttcagcactttcaccgtctctaaaaaataagtcaaaggggatacagtcgattttgaaagtaccacagccagttcccctcatagctcagaagccagttggtgaaatgaagaattcgtgcaatgttcttcatcctcagtctccgaataattccaacaggcaaggttgcaaagttccatttggtgaaagcaaatattttccatcttcctctccagtaaacattcttttgtcatcacagtctgtctctgacaccttcgttaaagaggtcttaaaatggaaatatgaaatgtttttgaactttggtcagtgtgggccccctgcaagtctttgtcagtccatctcaagacctgtgcctgtcagatttcacaattatggagattattttaatgtttttttccctttgatggtattgaatacttttgaaacagtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatcca

SEQ ID NO: 179832 - DNA, 5730 bp, Homo sapiens
  Payload ID: 15438
  Gene Symbol: SETX
  Gene Name: senataxin
  ENST ID: ENST00000436441
  CDS Start-End: 1-2847
gtggcacaagaatggctcaactctccaaatagagagaatttctatcagttgcaagtacgaaaatttcctgccgattatataaaatactgggagtttgcagtttatctggaagaatgtgaactggctaaacagctttatccaaaggaaaacgatttggtgtttttagctcctgagagaataaatgaagagaagaaagatacagagagaaatgacatacaagatctccacgaatatcattctggttatgttcataaatttcgccgcacgtcagtcatgcgtaatgggaaaactgagtgttacctttccatccagactcaagagaactttccggccaatttaaacgaacttgtgaattgtattgtaatcagttctctggtaactacacaaaggaagttgaaagccatgtctctgttgggtagtcggaaccaactggctagagctgttctgaatccaaaccctatggacttctgtacaaaagatttactgactacaacatctgagagaattattgcgtacttaagagatttcaatgaagatcaaaagaaagcaatagaaactgcatatgctatggtgaaacactcaccatcagttgccaaaatctgcttgattcatggaccacctggaacaggaaaatcaaaaactattgttggcctcctctatcgtctactgacagagaaccagaggaaggggcattcagacgaaaactccaatgccaaaatcaaacaaaaccgtgtcctcgtgtgtgcaccttccaatgcagctgttgatgaactcatgaaaaaaattatccttgaattcaaagaaaaatgtaaagacaagaagaatcctttaggaaactgtggagatataaatttagtacgactgggtccagaaaagtctattaatagtgaggttctaaagttcagtttggacagccaagtaaaccacagaatgaaaaaagagttaccttctcatgttcaggcgatgcataaaagaaaggaatttctagattatcagctggatgagctttcccggcagcgagctctatgccgaggtggacgggaaatacagaggcaagaattagatgaaaacatttccaaagtttctaaggaaaggcaggaacttgcttctaaaattaaagaggttcaaggacgcccacagaaaacacagagtatcatcatcttagagtcccatatcatctgctgcacgttgagcacaagtggtggtttactacttgagtctgctttccgtgggcaagggggtgtccccttcagctgtgtcattgttgatgaggctggacagtcttgtgaaattgagactcttactccactcatccatcgctgcaataagctcatcctagtaggagatcctaagcagctccctccgacagtcatctctatgaaagcacaggagtatggctacgaccagtcaatgatggctcgcttctgcagactgctggaagagaatgtagaacacaacatgatcagcaggctgcccattctacagctcactgttcagtacaggatgcatccagacatatgcctcttcccttctaattatgtttataacagaaacttaaaaacaaatagacagacagaagccattcgatgttcatcagattggccatttcagccataccttgtgtttgatgttggagatggttcagaaagacgggataatgactcatatataaatgttcaagaaataaaactggtgatggaaataattaagcttattaaagacaaaagaaaggatgttagttttcgaaacattggcataataactcattacaaggcccagaagacgatgattcagaaggatttggacaaagagttcgatagaaaaggaccagcagaagtagacactgtggatgcattccagggtcggcagaaggattgtgttattgttacgtgtgtcagagcaaatagcatccaaggttcaattggattcctggcaagtttgcagagattgaatgtcaccatcacacgagccaagtacagcctcttcatcctcggacatttgaggaccctgatgcaacttcttcctaggagcttttgtgtacacgtgaaccattcgccttttttcagcccagaacccaagtatctacactgggctctcaaggaaaaccagcattggaatcagctgattcaggatgctcagaagcgtggtgccattattaagacctgtgacaaaaactatagacatgatgcagtgaagattctgaaactcaagcctgtgctgcagagaagtctcactcaccctcctaccatagccccagaggggtccagaccccagggtggtttgcccagcagcaagctagacagtggatttgccaagacatctgttgctgcttctctataccacacaccctctgactccaaggaaattactcttactgttacttcaaaggaccctgaaagacctcctgttcatgaccaacttcaggacccacgactgctgaagaggatgggcattgaggtcaaaggaggaatattcctttgggatccacaaccctcgagcccccagcatcctggagcaacacctcctacgggcgagccgggcttccctgtcgttcaccaggacctgagccatatacagcagcccgctgctgtagtggctgctctgagcagccacaaacctcccgtgcggggcgaacctccagctgccagtcccgaggcttccacgtgtcagagcaaatgtgatgacccggaagaggagctctgtcacaggagagaggccagggctttcagtgaaggggagcaggagaagtgtggttccgagacccatcacaccaggaggaactctaggtgggacaagaggacactggagcaggaggacagcagttccaagaaaagaaagcttttataggaaagcccagtgacatgggccagcagccacagcatattgtaaactgaagatgaccagctcgtgggaccatctagataagcttgttttttgtaaggagtttgtgtgctgttggaaaacatggaaaatgcatccttaacacctgagcctctggtcatcttcagtattttctgtcatttgcaaaagctttcagagggcattgtgtatccgtaataatgtccttgaagtcagagactggaaatgttgatctcttagtcttctatagacaaggaggtcagactggagtgaatgttgtaaaagttgaaatgtatatttgtatagcaaataacaaaatccttttaaaatttaatctagtagaccgcttttctttccccctgtttaaaatgttaatcagttttcaacagaacaaactttatattaccaaaaaaaaaaagatgggaggagggcgggtcctttcaaccattgttagagcaagacagataattatttaacagcctagcttggaataagctgagttagtgctggtgggtcaggtgtctctggctctattaaaaaaagcaaaaacccccccaaaaacctggagtctcctaggggacactttgggcagcacggttatgttaggtaaagtcttgctgacatggtgcatttttagatagagtgcattggcccagggtattatatttctgtgatgagttcatttacctgtttcagtatgcacatagttccctagctaaaattcctaatcttcttgagagagaagaatatggagtgaaagaataattcttgagctatcattcaaatgctcccagcatattgtgagccttgtgtgactggtgaggtacagacatttggttgccaaatgctagattagcgctgggtcagctgtggaagaatcgcctcagcttacagattgtcagacagatctaactagttttccagaaagcctgggaagctgtgtgttcaacatttcccaagggattctgatcaccaggcagcttgggaaccactggggcaggccaaatagaatattttgggcgggaaagaagcacccgatttaaaatgaagcgtaaccagaggagttcagaactgggaagagagtggtagacttcctgtgatcttcagaaatcatctacctggtaaaaatacatgctgtttagaatatctgataggtgtttccagctactattagaggtgatagtgcttttgtgggggaaaaaattggtcatggtgaatggagatcgaggaagctcgggacaagggaggggtgggctgcctgattttgtccagttttccaaatatccacgcagtgaactggagtatcctaaacatgagaatgtacagttgacagttgtaaaaactagggatctgtagtgaatgctgtgcagccccatatctcatttgggggtaggaaaatagctgaagattcatgtgcattatttgacatttcctttgtcatctgctttttaagcaaaaaagggttttgtgttagaaattctacttgagcagattataaagagctttaaaaaacaactttcggttgccaaaagtttgagcatttgatttcattacctgtgtctccctcactggtgtccagacggtcaactgaatactcctgaaacccagggagcaggtgacttcctggagtgctttgtccccagagtcagccactgcttcctctgtgggggtggagagtttgtctttggccatgcagtgtgcgacagttcaggacgggtagggatgggtcccattctgtctgggtcaagggctctatcagcttcttccatgtgcctttgggaagaaatctcgttactttaagtttgctttcctgttatcttgatgaagtgcccattttagcagacacttgtagtgctgaccacttagggaatgtacaaactcctaagcttctaaagggaggcatggcaaaaacgttggggtcaggatgtctctcacgctgctcatgttaatactattaacacatgatttgagaaataagttttctctaaaatgcatattttgccgccacacactgaacaatattatttccagtgaagtttgatgcctgttcttacgttgtgttcacctgttggttcaccactcagcagatctgattctgcaagaattaatggtagaactagatcatcctttctaacagacgagcctgtgtcctgtgacggcctttcacagcggaatgcagttgtacctcacattacttttgaaacttcactcgttccagttggtacaagtatttgccaaagccatttcctatgttcaccgtggcccctcctgatgtggctgtcagcgcagcgttgttgaacagggctattctttttacaaggtgtgaagtgtggctcttcgcttcgtctttgccatggcattaaaagaaagttccctgtcttctttcaatattagttatttcaaatgaatatgtgctacttaaaagcttgttttgtttctttgtatataatttgccttggatttattgtgcacagtttgttgagttgtatgtttttgtgaattatcaggagtaaatttgacaagtacatgtgaataacctcctgtaaatgaattttataacaaaaatgtactgaactattttttaaagttgtgcagattagcaattttttgctatagctttgacttttctatgctgtgaattaatagctgcgatttggcaaacagccctgttgtctttgttaaaccctaaattttaagaggaaatggcagaattaaaagcagaaacaagaagatggacatggattagaggttatgtattatgaagtaaactacaaggtactaacatcatttcgtctgccatttggtttgctttatgctgaaattacttggtggggatttgtgcaattcagatataaaaagtttcattatcca

SEQ ID NO: 179833 - DNA, 3519 bp, Homo sapiens
  Payload ID: 15439
  Gene Symbol: SENP3-EIF4A1
  Gene Name: SENP3-EIF4A1 readthrough (NMD candidate)
  ENST ID: ENST00000614237
  CDS Start-End: 1-1623
gatgcctcagcaagtgaagaggaggaagaagaggaggaggaggaggatgaagatgaagaggaggaagtggcagcttggaggctgcccccaagatggagtcagctgggaacctcccagcggccccgcccttcccgccccactcatcgaaaaacctgctcacagcgccgccgccgagccatgagagccttccggatgctgctctactcaaaaagcacctcgctgacattccactggaagctttgggggcgccaccggggccggcggcggggcctcgcacaccccaagaaccatctttcaccccagcaagggggtgcgacgccacaggtgccatccccctgttgtcgttttgactccccccgggggccacctccaccccggctgggtctgctaggtgctctcatggctgaggatggggtgagagggtctccaccagtgccctctgggccccccatggaggaagatggactcaggtggactccaaagtctcctctggaccctgactcgggcctcctttcatgtactctgcccaacggttttgggggacaatctgggccagaaggggagcgcagcttggcaccccctgatgccagcatcctcatcagcaatgtgtgcagcatcggggaccatgtggcccaggagctttttcagggctcagatttgggcatggcagaagaggcagagaggcctggggagaaagccggccagcacagccccctgcgagaggagcatgtgacctgcgtacagagcatcttggacgaattccttcaaacgtatggcagcctcatacccctcagcactgatgaggtagtagagaagctggaggacattttccagcaggagttttccaccccttccaggaagggcctggtgttgcagctgatccagtcttaccagcggatgccaggcaatgccatggtgaggggcttccgagtggcttataagcggcacgtgctgaccatggatgacttggggaccttgtatggacagaactggctcaatgaccaggtgatgaacatgtatggagacctggtcatggacacagtccctgaaaaggtgcatttcttcaatagtttcttctatgataaactccgtaccaagggttatgatggggtgaaaaggtggaccaaaaacgtggacatcttcaataaggagctactgctaatccccatccacctggaggtgcattggtccctcatctctgttgatgtgaggcgacgcaccatcacctattttgactcgcagcgtaccctaaaccgccgctgccctaagcatattgccaagtatctacaggcagaggcggtaaagaaagaccgactggatttccaccagggctggaaaggttacttcaaaatgaatgtggccaggcagaataatgacagtgactgtggtgcttttgtgttgcagtactgcaagcatctggccctgtctcagccattcagcttcacccagcaggacatgcccaaacttcgtcggcagatctacaaggagctgtgtcactgcaaactcactgtccaggggaatcctcccatccctacgatatcgctgttgattccttcatccctggcacacgtccaggcagtgtcgaatccatctctgctacaggggaaaacaaataacatttgagtccagtggagaccgggagcagaagtaaagggaagtgataacccccagagcccggaagcctctggaggctgagacctcgccccccttgcgtgatagggcctacggagccacatgaccaaggcactgtcgcctccgcacgtgtgagagtgcagggccccaagatggctgccaggcctcgaggcctgactcttctatgtcacttccgtaccggcgagaaaggcgggccctccagccaatgaggctgcggggcgggccttcaccttgataggcactcgagttatccaatggtgcctgcgggccggagcgactaggaactaacgtcatgccgagttgctgagcgccggcaggcggggccggggcggccaaaccaatgcgatggccggggcggagtcgggcgctctataagttgtcgataggcgggcactccgccctagtttctaaggatcatgtctgcgagccaggattcccgatccagagacaatggccccgatgggatggagcccgaaggcgtcatcgagagtaactggaatgagattgttgacagctttgatgacatgaacctctcggagtcccttctccgtggcatctacgcgtatggttttgagaagccctctgccatccagcagcgagccattctaccttgtatcaagggttatgatgtgattgctcaagcccaatctgggactgggaaaacggccacatttgccatatcgattctgcagcagattgaattagatctaaaagccacccaggccttggtcctagcacccactcgagaattggctcagcagatacagaaggtggtcatggcactaggagactacatgggcgcctcctgtcacgcctgtatcgggggcaccaacgtgcgtgctgaggtgcagaaactgcagatggaagctccccacatcatcgtgggtacccctggccgtgtgtttgatatgcttaaccggagatacctgtcccccaaatacatcaagatgtttgtactggatgaagctgacgaaatgttaagccgtggattcaaggaccagatctatgacatattccaaaagctcaacagcaacacccaggtagttttgctgtcagccacaatgccttctgatgtgcttgaggtgaccaagaagttcatgagggaccccattcggattcttgtcaagaaggaagagttgaccctggagggtatccgccagttctacatcaacgtggaacgagaggagtggaagctggacacactatgtgacttgtatgaaaccctgaccatcacccaggcagtcatcttcatcaacacccggaggaaggtggactggctcaccgagaagatgcatgctcgagatttcactgtatccgccatgcatggagatatggaccaaaaggaacgagacgtgattatgagggagtttcgttctggctctagcagagttttgattaccactgacctgctggccagaggcattgatgtgcagcaggtttctttagtcatcaactatgaccttcccaccaacagggaaaactatatccacagaatcggtcgaggtggacggtttggccgtaaaggtgtggctattaacatggtgacagaagaagacaagaggactcttcgagacattgagaccttctacaacacctccattgaggaaatgcccctcaatgttgctgacctcatctgaggggctgtcctgccacccagccccagccagggctcaatctctgggggctgaggagcagcaggaggggggagggaagggagccaagggatggacatcttgtcattttttttctttgaataaatgtcactttttgaggcaaaagaaggaaccgtgaacattttagacacccttttctttggggtaggctcttgccccaggcgccggctcttctcccaaaaaaaaaaaaaaa

SEQ ID NO: 179834 - DNA, 1090 bp, Homo sapiens
  Payload ID: 15440
  Gene Symbol: SNTN
  Gene Name: sentan, cilia apical structure protein
  Uniprot ID: A6NMZ2
  ENST ID: ENST00000343837
  CDS Start-End: 21-464
acaaaacagaagatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagggacaagaaaccaagccaaaatacagagagatcctttctgaacttgatgagcacacagaaaataagctagattttgaagacttcatgatcttgctcttaagcatcactgtcatgtcagatctgctacaaaatatacggaatgtaaaaattatgaaatgaacagttttaaatatgctgtataaaataatggcaaaagacagtgttattaaaatgtttccatcttatttttgattaattgaatatatctatcatgcatctgaaattgcctaggatggttctgattgctggtattcagatccaatgtaactccaaatatttacccatacacttcaagaatgtttgaatgataaggtctctgtgtgctttacaataggatagatttgataccactgaataataaatggcttttgctgagtcagtagcgacctagagcactctacttatagtcattgagtcactcatttattcactaaacatttgttgagcatctacttgatggaactgctgaggatacagtaatgaattggccaggcaattccttccttcagacatgtttgcagaagtctagcagaagagatagacattgaacaatttttaaataattgcatacacagtataattagaattgaaataagggctataggatgctaaaagagattatcacctgatcggagttcaaaggtcagaaaagctttactgacattctataaaaagcaaaaaaaaaaaaattggtccatggatgccagggatatgggtgggaaatggggctgtccacaaatggcaca

SEQ ID NO: 179835 - DNA, 3746 bp, Homo sapiens
  Payload ID: 15440
  Gene Symbol: SNTN
  Gene Name: sentan, cilia apical structure protein
  ENST ID: ENST00000496807
  CDS Start-End: 3-350
gtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagccctgtgaagattcaaggagaagttggccatctgcaaagctggaagagtctacccttagtagacactggatctgaagggcaccttggtcttggacttcccagcctccaaaactgtgagatgctgtttgagccattcatctatggtgggctgttatagtagcccaaattgactatgataaggactaaggtacaaaatgagagttggtggagatcctgagaaagtatcaggcctattcagagatgaggaaagcttattccaggtgaaggtagggagtggcacaggtgagaggaatcttgggtgggtgggtgtttatggtaggtctcgactaacgaatgtattcgtataatgaataaggaattgtggaagtaggaggagatgttgtatttattctgtttatttctacagatctctttactcttttctaccctgccttgtttccagaaaggctgacctgcatggactgcatcaacaggcaatcttgtctttggcttctcattgcattaggccaatgaccttgtagatgattagtggtggaggaacatgaacatataatggctagatggacaaaaggaaagatgaatgaataaaatcagtggcctctgaatgttactattaggtggcttgaccttgactttctagtacatatttgggtagaatcatttgttcatcctctgtgatacttctccgggttttgtttgtttgtttgtttgttttgagatggattctcactttgtcgcccaggctggagtgcagtggcaccatcttggctcattgcaacctacacctctcgggtccaagcaattctcctgcctcaacctcccaagtagtggggactagaggtgcacaccaccacacccagcttaatttttgtatctttagtggagatggggtttcaccacattggccaggctgatcttgaactctttacctcaggtgatcaacctgccttggcctcacaaagtgctgggattacaggtgtgagccactacacccagcctctcagattcttatgtagttctatggctaagttttagaagtcccatttcagggggtaattaatagagtcatatttcttccaacaaagttgtaatctctgagctgtttgtgctcttggcacaaaagaggatgcagacaggaggatatagttgaaaaaagaaattatgagaagcattttgcaaagtaaaattaggaggagggaatgatgaagctaaaataaatgtttcctgttgaagtctgctttgtattacaaatcatgaaggggcttgattggatagcctgctggtgacaaatagcctgcaattcatttctcttactgacatttggccaaaatgctgcaagatacacataaatgttacttgacagtgcctttcagcattttgagggaggataaggcagggctctgctcaaagaaatacctgagtttttggaaccaattctactgcacattacccttaaccctatatgctcctttaccaatcaagggacctacaagatacaagtaacacattcaaacatgctaattgaggagacataacaagagaaccatctacaaagtgctgacagggtttgagagaaccagcaaggtatgatgaagcaccctggacctagtatgaaagcaacacagaagaaaccggaggtgagagaggcagaaagaggggttcatgttgacgctgtacaagcacctggctccagtcttgttggagtgcagcaattcatgaagctagattctccctctacctctcaattatgtaagccagtttgtcatcttttttggcttgagctagttgaagctagtttttatcacttgcaatactgctcatctaggctcccttttccctgagtccatccctacagtgctatcaatcactttgtacagtgccatttattttttgcgggggatgggaatcagactcccccactagactcagagttttcacttttcctctttacctggggcctggtgcaagtttgtaagtgtttaacaaatatggaaagcaagcaatacaagagtcagggttccaagacaaggtagttcagtattcctagtttcttaataaggtaataaggaagatgatgttgattatgatgaccaccaccactaggtggtagttgtggtaatgataatggtaatgatgacatttaccatttattgaggattgcacctttaagggctttacaaacattttctcattacatcatcagaaccaccacctcaagtagctgtgttagaccatgcttctcatcaggaagcagaggctcagagatttcaggcaactcatccaaagtcacacagctagaagtggcagtcacagaatattcactccaaagtccatgctcttatccatcatgtgaatagcccccaagcctttctttctacttcttcattttcctgaataaaactccctatcctgacatgccattcttgactctgcctttgcttgaactctatcagagcaaggaaataggactaagcattttcccgtctcacctccttatgccaggcctggcccctgatataccatgtggcttcatgtcaggctgagcacagaagcatcttcacagaatcactttggggcctgagaaatatggtggcacctgaatcatagagttcatacccaaaagtttaggaggaacaaagcctgattcctacttcagaacgtccaagttaattccccaaaatatccaatgcttccttagggcccagaagcaacctaaagcatcatcgaagcatacagctttgaagtcaaatccacctgggtcttaattctgactctttcacaatctgggtgactttcggcaaattgcatcaactggggaatgcctacctcagaaaaatgatgagagaatggagagaattagcactgaccgtagtaaactaatggtatcttgcatatagcaattattccagcagtagtagctatatttattattatcgaaatctcttgtttttcagatgactgaaagccaaaaaagcttccagaggagttacagggaaatgggggaaagataaagaatcccgttactccacacctctactacctattgttccccatacacacatgtatatgtctccatcttttaacaggcatgcatccttctccaggaagtctttggaccctccttcccccagtggtgttaagagttgcctgatttacgtaataaaaatatggaacacccagtgaaatttgaacttcagataaacagcaaataccttttacagtataaatatgtcccaagcaatattttgaacatacttatactaaaaaagcatgttttgtttatctgaaattcaaatttaactaggcattttatccacagtcctagttatacgctcctctgcagtgtgtcacaactctcctgtgcagtgtttttctttctgtattataattggcctatgtcaggagctgacacctgtcacatctgagttaacgtgtaactttaagatcctctgatattaaagaattaatgtt

SEQ ID NO: 179836 - DNA, 508 bp, Homo sapiens
  Payload ID: 15440
  Gene Symbol: SNTN
  Gene Name: sentan, cilia apical structure protein
  ENST ID: ENST00000469440
  CDS Start-End: 10-508
gatgagagaatgggtggctgtatgcacagtacccaggacaaatctctccacttggaaggagatcccaatccttctgcagccccaacatccacctgcgcacctaggaaaatgcccaaaaggatttcaatatccaaacaactggcttcagtgaaagctctgaggaagtgctcagatctggaaaaagctattgccaccactgctctgattttcagaaattcttctgactctgatggtaaacttgaaaaagctattgccaaagatctgctgcaaacccaatttaggaatttcgcagagctccccttcaccttctaccatgagtggaagcagcctgaggtcctcaccacatgcagatgcctgatcttgaactttccagccatcagaattggacaagaaaccaagccaaaatacagagagatcctttctgaacttgatgagcacacagaaaataagctagattttgaagacttcatgatcttgctcttaagcatcactgtcatgtcagatctgc

SEQ ID NO: 179837 - DNA, 3344 bp, Homo sapiens
  Payload ID: 15441
  Gene Symbol: SEPSECS
  Gene Name: Sep (O-phosphoserine) tRNA:Sec (selenocysteine) tRNA synthase
  ENST ID: ENST00000358971
  CDS Start-End: 26-364
attcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagagtctcgctctttcgcccaggctggaatgcagtgtgacgatctcggctcactgcagcctccgcctcccgggttcacgccattcgcctgcctcagcctcccgagtagctgggactacaggcgcccgccaccacacccgggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttgg

SEQ ID NO: 179838 - DNA, 5496 bp, Homo sapiens
  Payload ID: 15441
  Gene Symbol: SEPSECS
  Gene Name: Sep (O-phosphoserine) tRNA:Sec (selenocysteine) tRNA synthase
  Uniprot ID: Q9HD40
  ENST ID: ENST00000382103
  CDS Start-End: 74-1579
attctggttccgtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttgagatttttgaattgagaatttcatgggaatattcagtcaaggagcagactttggtctgaactagccattgatgattgttaagtttcccattcttagactgcatcaatccttgtgatccttaacaggttataatatacaattagcatttttctaattgttagaatatctgtcaattaagcatcatgactcagataatttttactagtgtaatgacagtaaaattacttcaattctctttgaaatgtagagtgcttcctcctaaccattctttaccgtttctgatcacacagaattgagaaagatctcttaggccactagttactagttgtttgttgagatgtgtaagtcacagtgtgcctgtaaaatgggcattccccaaggaagcagagtcaaggtataaactttcgttttgactcaaaagcagtgggtctcaactggggatgattcgcttatctgaacagcatctgcagacatttttggttgtcacaactggtgggatgctgttaacatctagaggatagaggccagggtgctactcaacatcctacaatgcatgggacaactcccacaacaaagaattatccagcccaaaatgtcattagtgctgaggttgagaaatactcctctaaagtagataaactccttgagtaaagagaagtttaccatagcaactttcagtagtacttcaaagaagatagctgtataaatgtcatcaaactatactatatagagaatcttaagtgataaccagggtcacggattccaaacatgtcattataaattgttttatatggtgctcactggtgcatttttccttttggataagggaaaacattattccacttactgtttttgctttaagcagcctgcatatattggttagtttgttcagatgttgtgcacagacatcatcaaaattagctaacatgggtatttttgaacatatttttgccaggaagatgaaaatcacatagtatgataaacaggtgtattcccctctacttgcccatgtgctcatttttctgagtctgaaattccagacttactggctttaacaataatttttgttgttaatttaagaaatagacttacttaagactattttaagaaatagagatgtcatagcctgaagatttactgaagcttctgaacatgccaccatgccaaagctatgtttctcaaacccagctctgtggatcatgttcctaaaagatgctcatggggagaaaatgtttacagacaaataattttgggagctgcctttgcaaacctgcctgttggcatattgaaggctctaagaattccttcactaaataacccagttttaatatatccttatccaaagagaaactcatttttttaaagtgaaatatttgttaacagcccattgaacatacttttaaaaacactatggtagagaatgctgtgttgccttctgggctgcatttttcttattgatttggaattgtaacctatgtatgagaaagggattttctggtattttggtgacgttgtacattgtcccagactgtttgtaaacatgaggtcagacatgtgtaaggtagacgcctatggccactggcttgaccaccttggaagtcaatgactattttgagatgaagtatttaactatgaatatcatgaaggttatttaaaaatgtatttattttatctttggggttcaaacattaaaaaaatttacataggtgtagtaactcatttcaagggaataaatgctggattaaaaagtgtaaatttttcatgagaatttgggactaaattgctgaaccaataaagctgaagagttgcaacctctagagtcaaaaaagggattgaaatgttgttgcaaatgtaaatgctggcagtgcagcttgctatacatgtaagccaaaattgttttatagaacaagtgatctatattgttgtgatcatcatttagcttaagaaaggccagagctgggagagtagcaaatgttttctcatctgcagtgtatcagcagttcttgggcttcagctgctgaatagataataattctaattgaacataaattacatgaactcacatgtgaatgatagatatgttacaatatttcattcctgatgcagaaaatcagctgtggtttttattattaaccctttctttttcagtggttttggaattctagctctattcctcctggcttaaaatttgagggcatagaattcacaagagtttttgaagagttctgtctattcaggctttcctttgtccccaccctagtgtcattttcactcactcccatttctacacataagtattaaaaaggatgtatttattataattcgctagtactgattggtaagcctcataattggcctttgttatctttgtactgtgacgaaggcagtggatgatacattaccaatcattgccgaagataacctcttctatctttttgacccaactacccttattaaaactatcaggtaaaatattggagttaggtttttaaagtcattgggctgtggcagtgtgcttagaaaagaaaatggtggaacatagaatattcttttggtcactacacaatgtgttacttatacatggcagggaagggaattttaaatcaaactcgcagtttggttcttaggtcctctgctgatgaattctcgctctatcagggaatgatatgtgacgccagccttaggaacctggtgttcaactgtaaatctttctatttagctttttgtattagttgaatgaagttatagaatatgaattattgaatacagttctgttcagccaataggcacttgatatacagaatggtaaatttaaatataaattaaatttttctaatattatgatcagcacttcactgtggttctgtgtctttaaccacctcataataagaactgttattgaggactgggctacagaatgtgcttagactacatctatggcttccatagattttagtaaaatttaaacagataatttgtgtttactgctgatgttactttaatattgaattagtagttcatcctgagagttatatttcacagaggaaaataaccaacagctgaaaacaacaataataaagctctggtgagtctgactcatactcggagaaagtttttggaatacatacacatttggtgcatataagagttgggtttccttttcccactttctgagatgtactaacctctgccagacccttaaatgattttgttatgttttgcatttttgaggccaaccttattttgtaactgaaaaaagtccagttttgcatacacagaaatttggtcattttagaagtctcacaacctgaataatttgataataattgaatatgctattaacagctttttaagaaaaggttctattagtcagttttttccttgtctgtcatattatgttggttaatgtctcttatggccaatcttagtaaacagacctaacactcactgcatccttttgtgccttactttttactttccttttgcccttttggtatgtgcgcatgtaagatggtaagtttaaggctaatgaatatatgtttgtaatttcctactcactactctgcagttaaagctaaggccttaggcaaaatctagaaatgtttatattgttttgttttttatcaagtggtgtcaacttgagaaatacaaagaaaggctatgcttaactgtataaccgtgggggattttagccatgagaatatgaagctgatgtcagcctgctaacctgttttaccaaaaggaaaagatgtttccaaaaatgttttcggtgtagactgtttaaagatgaaaataaattatataatttattatatgaaataaatttttgataagtca

SEQ ID NO: 179839 - DNA, 1494 bp, Homo sapiens
  Payload ID: 15441
  Gene Symbol: SEPSECS
  Gene Name: Sep (O-phosphoserine) tRNA:Sec (selenocysteine) tRNA synthase
  Uniprot ID: Q9HD40
  ENST ID: ENST00000514585
  CDS Start-End: 63-206
gtcgtgtgtctggcgtgtggagctagtgctcccgcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaaggttcattcatggcattggacgatccggtgatatttctgctgtgcaaccaaaagctgcaggctctagccttttgaacaaaattaccaattctttggtcctggacattataaagctggctggtgtccatacagtagccaactgctttgtagttcctatggcaactggtatgagtctaactctgtgtttcttaacattacgacacaaaagaccaaaggcaaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgatagattagaagaactggctgtgatttgtgctaattatgacattccacatatagttaataatgcttatggagtgcagtcttcaaagtgtatgcatctcattcagcagggggctcgagttggtagaatagatgcttttgttcagagcttggacaaaaattttatggttccagtaggtggtgctataattgctggctttaatgattcattcattcaggaaatcagcaagatgtatccaggaagagcttcagcttcaccttctttagatgtccttattactttattgtcacttggatcaaatggctataagaagctactaaaagaaagaaaggaaatgttttcatatttgtccaaccaaataaagaagttgtcagaagcctacaatgaaagactgttgcatacacctcacaatcccatatctttagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaagagacttgacaggtgtttaaaggcagtaagaaaagaacgaagtaaagagagtgatgacaattatgacaaaactgaagatgtggatattgaagaaatggctttaaaactagataatgtacttcttgacacataccaggatgcttcttcatgacatgcgaagggtttcttcttgatcatttgaaagaaatgataaggctgtagtacaagcaagcagtttaaagataagacttga

SEQ ID NO: 179840 - DNA, 561 bp, Homo sapiens
  Payload ID: 15441
  Gene Symbol: SEPSECS
  Gene Name: Sep (O-phosphoserine) tRNA:Sec (selenocysteine) tRNA synthase
  ENST ID: ENST00000513285
  CDS Start-End: 30-561
gcttattcgccactgtcgccaccgctgtcatgaaccgcgagagcttcgcggcgggagagcggctggtgtcgccggcttacgtgcggcagggctgtgaggcccgccgctcgcatgagcacctcatacggctgcttctggagaagagtctcgctctttcgcccaggctggaatgcagtgtgacgatctcggctcactgcagcctccgcctcccgggttcacgccattcgcctgcctcagcctcccgagtagctgggactacaggcgcccgccaccacacccggttaatgtttgtatttttagtagagatggggtttcaccatgttggccaggctgatctcaaactcctgacttcaagtgatcggccattcttggccttccaaagtgctcggattacaggcggcaagtgtccagagaatggctgggatgaaagtacacttgaactctttttacatgaacttgcaatcatggacagcaacaatttcttaggcaattgtggtgtgggagaaagggaagggagagtggcatccgcactggttgctcgtcgtcattacaggtatcttt

SEQ ID NO: 179841 - DNA, 544 bp, Homo sapiens
  Payload ID: 15441
  Gene Symbol: SEPSECS
  Gene Name: Sep (O-phosphoserine) tRNA:Sec (selenocysteine) tRNA synthase
  ENST ID: ENST00000503150
  CDS Start-End: 1-286
aaagtatattatatggccacgaatagaccagaagtcctgctttaaatccatgatcactgcaggttttgagcctgtggtgatagaaaatgttttggaaggtgacgagctgcgtacagacctgaaagcagtggaggctaaagtccaggaacttgggcctgattgcattctgtgtattcattctactacatcctgttttgctccaagggtgcctgataggaagagcttcagcttcaccttctttagatgtccttattactttattgtcacttggatcaaatggctataagaagctactaaaagaaagaaagctatgacacttaaaacactagatgaacaccgtgacaaagctgtcactcagcttggctcgatgctttttaccagacaggtttctggagccagggttgtgcctcttgggtccatgcaaactgtgagtggctatactttcagaggctttatgtcacatacaaataattacccttgtgcttacctcaatgctgcatcagccatcggaatgaagatgcaggatgtggacctgttcataaag

SEQ ID NO: 179842 - DNA, 1480 bp, Homo sapiens
  Payload ID: 15442
  Gene Symbol: SPR
  Gene Name: sepiapterin reductase (7,8-dihydrobiopterin:NADP+ oxidoreductase)
  Uniprot ID: P35270
  ENST ID: ENST00000234454
  CDS Start-End: 74-859
ggtcccgccccccgcggccgcaccgcctcctgcctggtctcgggtgccagcgccgccggcggagaacaggagcatggagggcgggctggggcgtgctgtgtgcttgctgaccggggcctcccgcggcttcggccggacgctggccccgctcctggcctcgctgctgtcgcccggctccgtgcttgtccttagcgcccgcaacgacgaggcactgcgccagctggaggccgagctgggcgccgagcggtctggcctgcgcgtggtgcgggtgcccgccgacctgggcgccgaggccggcttgcagcagctgctcggcgccctgcgcgagctcccccggcccaaggggctgcagcgactgctgcttatcaacaacgcgggctctcttggggatgtgtccaaaggcttcgtggacctgagtgactccactcaagtgaacaactactgggcactgaacttgacctccatgctctgcctgacttccagcgtcctgaaggccttcccggacagtcctggcctcaacagaaccgtggttaacatctcgtccctctgtgccctgcaacctttcaaaggctgggcgctgtactgtgcaggaaaggctgctcgtgatatgctgttccaggtcctggcgctggaggaacctaatgtgagggtgctgaactatgccccaggtcctctggacacagacatgcagcagttggcccgggagacctccgtggacccagacatgcgaaaagggctgcaggagctgaaggcaaaggggaagctggtggattgcaaggtgtcagcccagaaactgctgagcttactggaaaaggacgagttcaagtctggagcccacgtggacttctatgacaaataagcccatgtttttggcttcctgaacctttttgcccccacttttagacataccccagagccctgtggctccccacaccctgccataggggcagtcctgccttacacatagaagcattcatgcctgctgccctgccctcaggcacagccagctgtgagctcccaggtcattggccttaccagttgtcaggagtctgtgctgtgcaccctgggttataaggaggcttaggagagaggttatgggtattggtgtctctatccccaggaatagaacttaaggggtgggaagaacaggaaaagaagctggaacacagaagagaggaggttgtgtctcttgctcatagcaagcctgtgggtagaggaaagagtgatctggtgtcgaataggaggacccatgtagattcgcagatggcctggatgggaggaagggcagacggtacatgtcccagcccacatagatgccccttgctgagggtagcaggaccttctgttgaactttgtgtcctcactctgatgtctccttccttcagaatctaccacccctcccccaggctgggagaaggggctcctgggtgtctgtatacacgccaaaggcagatacaaataaaatacagattgtcctttc

SEQ ID NO: 179843 - DNA, 1592 bp, Homo sapiens
  Payload ID: 15443
  Gene Symbol: SEPT1
  Gene Name: septin 1
  ENST ID: ENST00000321367
  CDS Start-End: 47-1291
ccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgccctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaaaactgagcttcccgcggccacg

SEQ ID NO: 179844 - DNA, 782 bp, Homo sapiens
  Payload ID: 15443
  Gene Symbol: SEPT1
  Gene Name: septin 1
  ENST ID: ENST00000568577
  CDS Start-End: 10-150
acataccccatgtctcaccacgatgatggagctacagtgggacttggaatccagatgtgtgaaggatggagggttgaaggacaaggagtacgtgggttttgctgccctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctcgcttgacacagaccctggccattgagcgccggggcgtagagattgaggaagggggtgtgaaagtgaagctgacccttgtggacacacctggctttggggactcagtggactgctctgactgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgaggg

SEQ ID NO: 179845 - DNA, 1279 bp, Homo sapiens
  Payload ID: 15443
  Gene Symbol: SEPT1
  Gene Name: septin 1
  ENST ID: ENST00000572252
  CDS Start-End: 6-218
cagtgatggctggcggagtcatggacaaggagtacgtgggttttgctgccctccccaaccagctgcaccgcaagtctgtcaagaaggggtttgacttcacgctaatggtggcaggggagtcaggcctagggaaatccaccctcatcaacagcctcttcctcaccaacctctatgaggatcgccaggtgccagaggccagtgctggcttccggtggtgaaattcatcgaggagcaatttgagcagtaccttagggatgagagtggcctgaaccggaagaacatccaggactcccgagtccactgctgcctctacttcatctcacccttcggccgggggctccggcccctagatgtggccttcctccgggcagtacacgagaaagtcaacatcatcccagtcattggcaaagcggatgctctgatgccccaggaaacccaggccctcaagcagaagatccgggatcagttgaaggaagaggagatccacatctaccagttccccgaatgtgactctgatgaagatgaagacttcaagaggcaggatgcagagatgaaggaaagcatcccttttgcagtcgtgggatcatgcgaggtggtgagggatggcgggaaccggccggtgaggggacgccgctactcctgggggaccgtggaggtggagaacccacatcactgcgatttcctgaacctgcgacggatgctggtgcagacacacctgcaggacctgaaagaggtgacgcacgatctgctctacgagggctaccgggcccgctgcctacagagcctggcccggcctggggctcgcgatcgagccagccgcagtaagctttcccgccagagcgccacagagatcccgctgcccatgctgcctctggcggacaccgagaagctgatccgcgagaaagacgaagagctgcgccgcatgcaagagatgctggagaagatgcaggcccaaatgcagcagagccaggcccagggcgagcagtcagacgccctctgaggccacgccccgcccggccttacctcggctccgccttcagtcggcctcttgtccaatccccgcgccccacactgcccagcgccccccgggacctccgcgggtgccgccctcgcgcgggctagggggaggttctcccagcctgagtccgtagccccgccccggcgctggtcccgcccacccagacaccgcccacttcccggcccggggcctgcacaatctccgaccgcatcactgtcttccggagtcccccttcttctcccagactctgtcttcaataaa

SEQ ID NO: 179846 - DNA, 3091 bp, Homo sapiens
  Payload ID: 15444
  Gene Symbol: SEPT10
  Gene Name: septin 10
  ENST ID: ENST00000356688
  CDS Start-End: 317-1951
gtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaaggaaccaggctgtcgattcgaactcctgtgcattgatgtcagagcttgtgaaaccaatggtggacgtaaagacgcagagaaagctccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaa

SEQ ID NO: 179847 - DNA, 3071 bp, Homo sapiens
  Payload ID: 15444
  Gene Symbol: SEPT10
  Gene Name: septin 10
  Uniprot ID: Q9P0V9
  ENST ID: ENST00000397712
  CDS Start-End: 380-1744
cacttccggcctcgcgagggccgcaatcactgctccgcagttcccgcctgcattcctcgcgccgtcttcctggagtcccagctctccttcagcccgccccaacgctgacgctcagtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttactaaaa

SEQ ID NO: 179848 - DNA, 2719 bp, Homo sapiens
  Payload ID: 15444
  Gene Symbol: SEPT10
  Gene Name: septin 10
  Uniprot ID: Q9P0V9
  ENST ID: ENST00000397714
  CDS Start-End: 101-1396
cccgttgcttctgccctccggccttcccgccgccgtcgccgggaccagccgctcggggccgggctgatacagccgcttcaccgtgcccctgcccgcgaccatggcctcctccgaggtggcgcggcacctgaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaactccaattttttgtaaaacagaagttccagagcacagaaggtcatcatcacaagcaaactttattaaaaaaaaactagaagtgtgctttgattttgctgttatttgttttatcacttctatatttggtgaacagccacagttactgatatttatggaaaagtactttcaagtacaaggtcaatacataagccagagtgaatgatactacaagttgagcatctctaattcaaaaatctgaaatccagaagcttcaaaatctgaatctttttgagcactgacttgaccccacaagtggaaaattccccacccgacacctttgctttctgatggttcagtttaaacagattttgtttcttgcacaaaatttttgtataaattactttcaggctatatgtataaggtggatgtgaaacatgaattatgtaattagagtcgggtcccgttgtgtatatgcagatattccaaacctgaaatccaaaacacttctggtccctagcattttggataagggatactcagcttgtacctatatattcatatatattcactgttgttagaaatgtttaagttgctgttctgtgatgaatctaaatcttttctcttgctaccaagctattgtcactgcagtgcattataccaaagagcgaagtcagtgccactgaaaatacagaacccattaatatcgtggctatctgattacatttatattccaagatgaaccttttttatatatgctaaaaattttggggaatatgttttgggatgtattatggagctaaaactctaacctcttaatagttttatagaacttaaaaattttttatacaattacccaattggtgatatgatcttaagcttttgtgtcagattatttaatatgatgacttcatgctttattatgccttattatggctgacgtattactgtggtgaaacaaaatatctttaaaagttaaaacatccagatatataagctattttttcctaaggataaagtacctttgagcatgagtgtatcacagctttcattaggaaaacttttcattacatacttgtttaaactctgtcttccagggtaaaaataataaggttgaatcattttattaaaaatactttttaagaaaataactatgaacatctgaatattaaagatataaaaatgcacataattcatatttcaggtggtatttgcattcagtgccttactggtattctcagaacattttaatgatttctaacatttcttaacagtcatagatatatacattttcattttttgtacttgaatattctaaataaaactgacatttactcttgacaaataaaacatatatttact

SEQ ID NO: 179849 - DNA, 272 bp, Homo sapiens
  Payload ID: 15444
  Gene Symbol: SEPT10
  Gene Name: septin 10
  ENST ID: ENST00000411469
  CDS Start-End: 100-272
agcggtgtttgtgggtctcttacggctataacggagttgaaggcgcagtgcggactgattgaatagcggtcatcttttgcagccctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtggg

SEQ ID NO: 179850 - DNA, 1605 bp, Homo sapiens
  Payload ID: 15444
  Gene Symbol: SEPT10
  Gene Name: septin 10
  ENST ID: ENST00000415095
  CDS Start-End: 9-1361
ccgcgaccatggcctcctccgaggtggcgcggcacctgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaagtaagaggcccagccaccctccctggcagccctgcccacacttgtcacattgccctgtcggatcttcctagcgcttcttacttctgcttccttatgctttgtcttccttctccaactaaatgtcagctcctggagaggagagaccttgtccctcttgttcactgctgtttccccagcatccagaacagcacctggcacatgttatgtgttcagtatttgccaaaatgaatgaatgaacaaaataaaaa

SEQ ID NO: 179851 - DNA, 566 bp, Homo sapiens
  Payload ID: 15444
  Gene Symbol: SEPT10
  Gene Name: septin 10
  ENST ID: ENST00000425498
  CDS Start-End: 95-241
gcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatagtgagtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacagg

SEQ ID NO: 179852 - DNA, 1782 bp, Homo sapiens
  Payload ID: 15444
  Gene Symbol: SEPT10
  Gene Name: septin 10
  ENST ID: ENST00000437928
  CDS Start-End: 233-1654
gccctccggccttcccgccgccgtcgccgggaccagccgctcggggccgggctgatacagccgcttcaccgtgcccctgcccgcgaccatggcctcctccgaggtggcgcggcacctgtgacgtctctccagtgaccttagtttgagtcacttggactcagaatcatgaagtcagcttcttgcagcctcaccttttctgctgtccttgcatttacatctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctgtgtgggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcagtgttcaagagacctatgaagccaaaagacatgagttccatggtgaacgtcagaggaaggaagaagaaatgaaacagatgtttgtgcagcgagtaaaggagaaagaagccatattgaaagaagctgagagagagctacaggccaaatttgagcaccttaagagacttcaccaagaagagagaatgaagcttgaagaaaagagaagacttttggaagaagaaataattgctttctctaaaaagaaagctacctccgagatatttcacagccagtcctttctggcaacaggcagcaacctgaggaaggacaaggaccgtaagaaggaaccaggctgtcgattcgaactcctgtgcattgatgtcagagcttgtgaaaccaatggtggacgtaaagacgcagagaaaggtagagagggccacagtgcaagggggcagccatgagtagcatgtggatgataatcgcaaggcgtgtaggtttgggctccaattttttgtaaaacagaagttccagagcacagaaggtcatcatcacaagcaaactttattaaaaaaaaactagaagtgtgctt

SEQ ID NO: 179853 - DNA, 581 bp, Homo sapiens
  Payload ID: 15444
  Gene Symbol: SEPT10
  Gene Name: septin 10
  ENST ID: ENST00000442746
  CDS Start-End: 397-581
atccacagcggtgtttgtgggtctcttacggctataacggagttgaaggcgcagtgcggactgattgaatagcggtcatcttttgcagccgtgagcacttccgagcctccctgccgccgggagaaagcccggctcccctggcttttcaaaagctctcccgttttatccgatggtgtggtcgtccaagttttcctccattgggattttaaaccgtttttttcccgccttgactcttttgtactctaaaagaacgcgtttgttcactgttttgaacctttccagttacttttgtagatttatctcgcttgttagtaagccagcggttttccaagtgtggttacaactattttcgttaatagtaccaaggtcgtgtacatcgagttttccaaaggctacatgctctttcagtctcacatggcaacgaaaacaacttgtatgtcttcacaaggatcagatgatgaacagataaaaagagaaaacattcgttcgttgactatgtctggccatgttggttttgagagtttgcctgatcagctggtgaacagatccattcagcaaggtttctgctttaatattctctg

SEQ ID NO: 179854 - DNA, 557 bp, Homo sapiens
  Payload ID: 15444
  Gene Symbol: SEPT10
  Gene Name: septin 10
  ENST ID: ENST00000423520
  CDS Start-End: 267-557
agtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatagtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagt

SEQ ID NO: 179855 - DNA, 581 bp, Homo sapiens
  Payload ID: 15444
  Gene Symbol: SEPT10
  Gene Name: septin 10
  ENST ID: ENST00000461295
  CDS Start-End: 503-581
tcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctggggaaactggaattggaaaatcaacactgattgacacattgtttaatactaattttgaagactatgaatcctcacatttttgcccaaatgttaaacttaaagctcagacatatgaactccaggaaagtaatgttcaattgaaattgaccattgtgaatacagtgggatttggtgaccaaataaataaagaagagagctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacaga

SEQ ID NO: 179856 - DNA, 583 bp, Homo sapiens
  Payload ID: 15444
  Gene Symbol: SEPT10
  Gene Name: septin 10
  ENST ID: ENST00000493445
  CDS Start-End: 288-583
tctgccctccggccttcccgccgccgtcgccgggaccagccgctcggggccgggctgatacagccgcttcaccgtgcccctgcccgcgaccatggcctcctccgaggtggcgcggcacctgctaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaacca

SEQ ID NO: 179857 - DNA, 980 bp, Homo sapiens
  Payload ID: 15444
  Gene Symbol: SEPT10
  Gene Name: septin 10
  ENST ID: ENST00000486678
  CDS Start-End: 267-383
agtcctcaggcgtcgagggtagctcctgtgaggggctcgcttggcgcaggcaaaacgctcagcgcgcaccacagggcgtccgccccaaccccgcccccggaggcctccagctcggccccgcccctgtcccttccccgtcgcggaggcagcctagcctcgcgccccgcccgttgcttctgccctccggccttcccgccgccgtcgccgggaccagccgctcggggccgggctgatacagccgcttcaccgtgcccctgcccgcgaccatggcctcctccgaggtggcgcggcacctgctctttcagtctcacatggcaacgaaaacaacttgtatgtcttcacaaggatcagatgatgaacagatactaccaaccaatagttgactacatagatgctcagtttgaggcctatctccaagaagaactgaagattaagcgttctctctttacctaccatgattctcgcatccatgtgtgtctctacttcatttcaccgacaggccactctctgaagacacttgatctcttaaccatgaagaaccttgacagcaaggtaaacattataccagtgattgccaaagcagatacggtttctaaaactgaattacagaagtttaagatcaagctcatgagtgaattggtcagcaatggcgtccagatataccagttcccaacggatgatgacactattgctaaggtcaacgctgcaatgaatggacagttgccgtttgctgttgtgggaagtatggatgaggtaaaagtcggaaacaagatggtcaaagctcgccagtacccttggggtgttgtacaagtggaaaatgaaaaccactgtgactttgtaaagctgcgggaaatgctcatttgtacaaatatggaggacctgcgagagcagacccataccaggcactatgagctttacaggcgctgcaaactggaggaaatgggctttacagatgtgggcccagaaaacaagccagtcag

SEQ ID NO: 179858 - DNA, 5593 bp, Homo sapiens
  Payload ID: 15445
  Gene Symbol: SEPT11
  Gene Name: septin 11
  Uniprot ID: Q9NVA2
  ENST ID: ENST00000264893
  CDS Start-End: 202-1491
cgggtggccatgttgctctaataaagcgggaggggcggcggcgtggggggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagaggaaagtggggtaaaatgctacctgtacgtctgacatgaaaacttctcaccgcctcagcagctgaactaaaaacctgaatagccatgacaagagtttgcattttcttgatgattcatctccatgagtgcacaatccctgaactcactgtcttttctccacacttgtcctaagccaaggtagatttgtacgtagacagactggtgagcaagcattatattttatttttacccttgcatgacattttcattttaatcaataacattatttggcctgagcttgtgggtctgttcagactgtctcctctcatggtttgaaactgcatctgaatgcctgccttcaatcctggccaagttggagtagactggtatgagaaaactatgattagttcacatttactggtgcatccttgatcctctcacagatagaggtcttaaaggttggatcatgtaacattgcttagtagaagaatcttcttctaaggatgatgggctttctacagcctgcttaccactaacagtaaggaatctttcataaacacacctcagtttgttcccagtgggcttagagggaggacctgatgactgattccaggatacttgtacttctaataacatttttcatgaatcatgagaaaatttccacagatacttcccttagaaaatttgctataaactctgtatcattggtagcacaaatttgagcgaggccttgtcaattttaaggtggaaataggaaggaccacaacatgacccgtaagtcaagaaggtagacatttcatatccagcttccttgcttagtctcctttcagtatttggcaataaaagaaagaagaaatagaacagctgaagtctcaaatcattgtctggaattttcctcaccttggctagctccacctgctctttgtctaaggcccttgcctcatcagggattagaactggcccatatgccagaacctgtactaaatgcctaatttgtatggaagagtgcatatttaatctcttttctatactgctcctttctgatgcttatcctttcatctgtgtgattgttttttcccctctactaacaagatcctcccagctttctctctacatgtagaaaggataacatttctcatgaacccactgcccctctgcattttcctcactggttagagattaagtaaataggatagaatatgctgcgtctcccctgacacacactttcttttttgaatgagcaagtctccattttgatttcagcaaagattttttctccttttctttgtcctcaaccatacttagaggaaagaaggaatggtcttccatgaactgattatgcttaattaagcaaagtaaggaaattagtttcatggaagcctaaacaaagctggaatagaaactacacactagacacagcagtagtcatagtcttcacaggtttaggagctactggaccaacattcttgtttttgcttttgtttttttaaataattctagtctggagctaactgtggagcagccaaatagtagctggcatgttgattcaaaccatgggctgaatttgctcataggctgtgcatcagacaaaagcttgaatatttgtgttgtatgcttgttccaaccaccgcttgtgtgagcatttttgtggcttgtacagaaagtacacttttaaattgtctcttgcatcactaaaatttttttaaaatgagcataacaacgaaaggcatccagctgactttttgattccaagattattgattggattgacttttttgcattaaatttttcccagcaaaataaatcatatggcgagtcagggaataaaaagtcaaaagaaacaaatagaagcttttttttttaaaaaatgtattgcttctgaacttttttctgccactgctccctagccctgtttagtttgttattgctgcttttcttttttctttctgtatctatgcctttttttcacagtagtccttggctctgcacggaataaatgataccctcaaatctaattggatgtgctttcgcctttgcatgtaagtacggtagtaagaaacctttgagatctttctgacttttcaaaattagagaaagcaaatgggatggatagattttttttttcttttcaaggggggcaggaaggtaatggtttgagtagcctttgtttaaaaaaaagactaaatatatttaaaaggccacatttatatttttttcacaagaaccacataataaattccacttcttgacctgaatttggaaatccgaaattactaatccaggccaggtgtggtggctcatgcctgtaatcccagcactttgagaggccgaggtgggcagatcacttgaggcctggagttcaagaccaccttggcgaacacggtgaaaccccgtctctacaaaaaatacaaaaattagccaggcgtggtggcacgtgcctgtagtcccagctacttgggaggctaagtcaggagaattgcttgaacttgggagatggaggttgcagtgagccaagattgcaccactgcattccaacctgggtgatgaagtgagactctccaaaaaaaaaaaagaaattattaatccctgcctgtgctctacatagcctcatgggcatcattggatagctcagagggcccttgattctggcaaggcaaataaagccagaatgagaaattaccatcttctactagagaaaaccaagagaaaaatttttatgctaggatgcctttatgaccacttaattttttaatcttagtttaatggtctctccctggtgctaactgctgacagtggccacctcttttttggggattgaggggcctacataactagctggccttaccccatatcttttgttcaaacataataccatctttttgcttcttctgaactttagatctccataacacatgtactgtagaatgtgatggaaaagcattgatgagaatttattggcagttcagattgtgttttcccaacttaggctctttattaattggttaaggttttctccaaaaagggcatttcaacaatgggaattatttaatgtaacagtgggcacagattacttatcttccttctctgctttgtgactcaccagcagtaacacacacaatccacatcttgtgcacctcaaatgaacagacttggtttccttgctttcttgacatttccatgactgtttcacatacaaactattgggtgaggtttttcagctgttaccgacccacgtcctgctgtctctgtgtggtcctacaaaaactgtccattcccacccctttgctttgccatttgcaagagtctggaattgtcaggtctcagcttcgaaaagtcctggttccactgacaggacacattctttagtgggaattaagacctacaaagtctagtttgtatgtaggtatgaagggaattttttaaataaattgaaaagctgtgaacagcattagaactttgtctatttcttaattttaaaatatgctgatatgccttaaactgtagttgtagatccttgtcattttgctgtttgaaaataaccaatgtgttttctaaaactgtcgtgtaatctactttcattgttaatgcagaattgtcatatatgtaagctgcatgttagacatttgtcttttttaaactaaagtaattgtattgatgtgaagcatatcattttttcaaatatgaaagtgatcacttagcaacatgcttggtaatttggcatctgttaaggtaggagagtggtgaacagataatctatgcatatatcactagtgccaagacataaagcgggggaaaatatatttttacccaaacatt

SEQ ID NO: 179859 - DNA, 1870 bp, Homo sapiens
  Payload ID: 15445
  Gene Symbol: SEPT11
  Gene Name: septin 11
  ENST ID: ENST00000510641
  CDS Start-End: 755-1870
ggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaaggggcaagaacatagcaactgctaagaaacacagttcattcacccagtgggagaagtactgaactaataaattagaagcaactcaaagaaagcaaacagcttggaacctaaggcatgaaaaggaagagcactcaggaatccagcctttttagttggggcaggcaattaatgctctgtgatttgaagaaatgtttatgaggtgcccaaatgtgatgttacacatttttaaaaataaaaagtagatgagaagaaaccgggtgagaaagaagccaagacccaggagagtgagtgacctgcttaagacccataggctcagaactggagccaaatcccctgacacttgcccacactacaaacccaaggacagtagaactaaggcgttctagataggtcatttgtagacagattcttcagtcgtttcacactgccaagtggagaaaacccaaactccccttctagtcaccgatcttgtgtttaggaccctggacactggtttatttatggtgaaaagaatctcactgttggagctgggctgcagatggaatgaatcaagtttaacttaggtcctcaatgcagttggatattttatgaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaa

SEQ ID NO: 179860 - DNA, 610 bp, Homo sapiens
  Payload ID: 15445
  Gene Symbol: SEPT11
  Gene Name: septin 11
  ENST ID: ENST00000512778
  CDS Start-End: 202-610
gcttccctcccaccctgtcttccttggagtactgcagaatctgtaagcgtccctggaatgcacacgtggaccttgtcattcccaaacagactttctgctgtctacatcggtaaactctgcaaaactccagcagttacagagcctgtgctaggagctacagggtgaagagggggaagaagactcaagaaacctgtaaaactaatggaggagaggaaaccagctcatgtgctgagaagttttaaatatgctgcatttatgaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgagg

SEQ ID NO: 179861 - DNA, 1886 bp, Homo sapiens
  Payload ID: 15445
  Gene Symbol: SEPT11
  Gene Name: septin 11
  Uniprot ID: Q9NVA2
  ENST ID: ENST00000510515
  CDS Start-End: 258-1577
agcactagcagcagccggagtcggcgtaaagcacccgggcgcagccggagccggtgccgcagctgcgatggccgtggccgtggggagaccgtctctcagaggcgtctgtactactgaaataggacctcagaaaaagacatgacctaagatgaagggtctacatcggtaaactctgcaaaactccagcagttacagagcctgtgctaggagctacagggtgaagagggggaagaagactcaagaaacctgtaaaactaatggaggagaggaaaccagctcatgtgctgagaagttttaaatatgctgcatttatgaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatgcaagcttcacataaagcctggcaagccaaggatgttcccgcattcacctgcttttgcagtaatatcgtatctctgccatgtgtgttctttagttttattttattttattttatttttttacccttcctcaaacaccagtaactattattaactcgttttgctgaatgttgttgggtggtagaaaatgatagaacaagggaataaccgcgaatgctctgtgcagctggactctgtttccggaaagtaaatgatttgctttttatgcctgttctgaatggcagcacgaagcaggcctgttacttgtatgtcgctttggacagagg

SEQ ID NO: 179862 - DNA, 659 bp, Homo sapiens
  Payload ID: 15445
  Gene Symbol: SEPT11
  Gene Name: septin 11
  ENST ID: ENST00000506731
  CDS Start-End: 1-482
aacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatccttggctctgcacggaataaatgataccctcaaatctaattggatgtgctttcgcctttgcatcttcttctttatgtaaccatcctgttgacaagccctactctctcctaatggacatagagcattagaagagcaggagctgtctgttcacacgtgttggggaagagttacctcatttccaccatcgcctcctgttc

SEQ ID NO: 179863 - DNA, 276 bp, Homo sapiens
  Payload ID: 15445
  Gene Symbol: SEPT11
  Gene Name: septin 11
  ENST ID: ENST00000502401
  CDS Start-End: 1-249
agagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaacttcttctttatgtaaccatcctgttgacaagccctactctct

SEQ ID NO: 179864 - DNA, 2079 bp, Homo sapiens
  Payload ID: 15445
  Gene Symbol: SEPT11
  Gene Name: septin 11
  ENST ID: ENST00000505788
  CDS Start-End: 96-1394
aggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaatagtccttggctctgcacggaataaatgataccctcaaatctaattggatgtgctttcgcctttgcatctgaccatctgcctcttgagagagagagaagtgggcatccttcctttaaattcaggaaccactgttgttttatttgactttttctgttacttgcatcccttatataagttgttttggatttgggactatgttttgggggagaaaaactccagttagttctgttttttgtattggttattcagcttacttttggtatcaaaattatgccagttttaagctcacttgagtgaagtttaagtcacaagattctgtttaacatgctttccttgttttggaaacaaccaaaaacttcccttttttgttacgggattttgacctacaaatcctaatcatgtttaaaatgtgccggtgttgggtagatgacttttctgcctctggggttcaatttatatttaaagataccttaaaataacttactggcccatccctgcctttttatttgttgtgaagctctgtaccttgtgtccacagctttttaccaagacccatatgtcttggaccatgggaaatgaaccccaaacaagtacatgtctcttctcccagataacagcatcattaacaatggttctgattcacattgtcttctcagagttacctaggtggatttctctacaatatctgcaaaaaaacctgctgagaatc

SEQ ID NO: 179865 - DNA, 548 bp, Homo sapiens
  Payload ID: 15445
  Gene Symbol: SEPT11
  Gene Name: septin 11
  ENST ID: ENST00000504637
  CDS Start-End: 171-548
gtaaagcacccgggcgcagccggagccggtgccgcagctgcgatggccgtggccgtggggagaccgtcttctacatcggtaaactctgcaaaactccagcagttacagagcctgtgctaggagctacagggtgaagagggggaagaagactcaagaaacctgtaaaactaatggaggagaggaaaccagctcatgtgctgagaagttttaaatatgctgcatttatgaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccg

SEQ ID NO: 179866 - DNA, 2615 bp, Homo sapiens
  Payload ID: 15445
  Gene Symbol: SEPT11
  Gene Name: septin 11
  ENST ID: ENST00000502584
  CDS Start-End: 154-1431
ggagcagatgccgctggctgccagcgggacgccggcgagcagagcgcagccgcgagggaggcgcgagggaggcgagccggagcccgagcactagcagcagccggagtcggcgtaaagcacccgggcgcagccggagccggtgccgcagctgcgatggccgtggccgtggggagaccgtctaatgaagagcttcgaaacttgtctttgtctggccatgtgggatttgacagcctccctgaccagctggtcaacaagtctacttctcaaggattctgtttcaacatcctttgtgttggtgagacaggcattggcaaatccacgttaatggacactttgttcaacaccaaatttgaaagtgacccagctactcacaatgaaccaggtgttcggttaaaagccagaagttatgagcttcaggaaagcaatgtacggctgaagttaaccattgttgacaccgtgggatttggagaccagataaataaagatgacagctataagccgatagtagaatatattgatgcccagttcgaggcctacctgcaagaggaattgaagattaaacgttctctcttcaactaccatgacacgaggatccatgcctgcctctactttattgcccctactggacattcactaaagtccctggatctggtcaccatgaaaaagctggacagtaaggtgaacatcattccaataattgcaaaagctgacaccattgccaagaatgaactgcacaaattcaagagtaagatcatgagtgaactggtcagcaatggggtccagatatatcagtttcccactgatgaagaaacggtggcagagattaacgcaacaatgagtgtccatctcccatttgcagtggttggcagcaccgaagaggtgaagattggcaacaagatggcaaaggccaggcagtacccctggggtgtggtgcaggttgagaatgaaaatcattgcgattttgtgaaacttcgagagatgctgatccgcgtgaacatggaggacttgcgagagcagactcacacccgccactatgaattgtaccgacgctgtaagcttgaagagatggggttcaaggacactgaccctgacagcaaacccttcagtcttcaggagacatatgaagcaaaaaggaatgaattcctgggagaactgcagaagaaagaagaagaaatgagacaaatgtttgttatgagagtgaaggagaaagaagctgaacttaaggaggcagagaaagagcttcacgagaagtttgaccttctaaagcggacacaccaagaagaaaagaagaaagtggaagacaagaagaaggagcttgaggaggaggtgaacaacttccagaagaagaaagcagcggctcagttactacagtcccaggcccagcaatctggggcccagcaaaccaagaaagacaaggataagaaaaagtaagcaggtgtcacccccctgtatcggggacctctaacaatttattcctcttgcatgtctctacttttcccatttacagactggaaactggtcctttaccagaaagataaaagcaagtattttctctacagtgcagggaagatgatgaaggtttttaaatttttttaaaaggtacacaaagattaatttataaaactttaccacaattgaccaagcaatcaggcctggaggaacctgttgtctccagtagcatcttccacaccaacactaggagtctcaaagaagacaggttgatgtctcttcagcaccctctgaagacaattctcatgactcttgatagagagcatcctaaaatcacaattgttaaaattattttcctattctgtgttgtaagacttcgtaagccagtcactgaaattctcgttcccaaaatgaaacatttggaagagctgctagtggccactagtttcctcaaaattcaatatgatgaattgttttattgtgaaatgggatccaaatgcctatccagttgacacctctgccaacctcaagccaaacctaaacccattcataaaaggttttttttaaatagggtcttaatgtcatgtgccaaagggtcagattctgctcttgagttggtcacttcctgtgatactccagtagcagctgcctgaaaccagtgggagatttaggcctcccttgacattctcctgtgatttgaagctctcctttgaatcatcataaagcctagttttatgtcaatgctatcggttttgacaggaagcacgatggtaagaataccactaacgaaaacctttgtggtgtctcaatgacaaatatgcagatgccaccctcctttgtctaatgtacggtgctttagggcagctatttaatataaagcaactcagaacttgtttcaggaagtgttgctctttcgccttacatgccaaggttctagggaaaaagctgaccatatgtaaaaacattgatgctcaagcacataaagaattacattctttaaacatagagtacataggatcaagtctctgcacaataattgagatgtgttatagggaaaagtgagcacagtgctattgtccacttagtcttggtgaatgtgcagtaggctcacccctaaggaatctcatgttgcctgcagtaaaaataaaaatggactgctacaatga

SEQ ID NO: 179867 - DNA, 1469 bp, Homo sapiens
  Payload ID: 15446
  Gene Symbol: SEPT12
  Gene Name: septin 12
  Uniprot ID: Q8IYM1
  ENST ID: ENST00000268231
  CDS Start-End: 265-1341
cttgggcccctggttctacttggggattattgtattattaggctggggtcattgtggggattagaagggtaacagctcctgctcctgctgcagagaagcctccaggtgggggtcacagcaagtgcagatggagctcagattcttcggttaactgtcaccctctcccctcccccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaa

SEQ ID NO: 179868 - DNA, 1156 bp, Homo sapiens
  Payload ID: 15446
  Gene Symbol: SEPT12
  Gene Name: septin 12
  Uniprot ID: Q8IYM1
  ENST ID: ENST00000396693
  CDS Start-End: 90-1028
cacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaa

SEQ ID NO: 179869 - DNA, 509 bp, Homo sapiens
  Payload ID: 15446
  Gene Symbol: SEPT12
  Gene Name: septin 12
  ENST ID: ENST00000588241
  CDS Start-End: 1-55
cttcggggaccagatcaacaatgacaactggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaacaaaa

SEQ ID NO: 179870 - DNA, 1436 bp, Homo sapiens
  Payload ID: 15446
  Gene Symbol: SEPT12
  Gene Name: septin 12
  ENST ID: ENST00000587603
  CDS Start-End: 91-927
tcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactgcctgcggcccctggacattgagttcctgcagcggctgtgccggactgtgaatgtggtgcccgtgattgccagggccgacagcctgaccatggaggagcgagaggccttcaggcgcaggatccagcagaacctgaggacccactgcatcgacgtctacccccagatgtgctttgacgaggacatcaatgacaaaatcctcaacagcaagttacgggtgagaggctgtggggcgggaggcgggcgaggtgatttccttcccacacatcctttccatccaaagactcatctttctctacatctcagggaaatgtgcacatattcctagcagatatgattctctactcatccacaagctcaaggaccgaatcccttttgccgtggtaggggctgaccaagagcacctggtgaacgggaggtgtgtcctgggccggaagaccaagtggggcatcattgaagtggagaacatggcgcactgtgaatttcctctcctgagagacctgcttatccgctcccacctccaagacctgaaggacataacccacaacatccactatgagaactaccgcgtcatcagactcaatgaaagccacctgctgccccgcgggcccggctgggtgaacctggccccggcctccccaggacagctgaccaccccccggaccttcaaggtctgcaggggggcccatgacgattctgatgatgagttctgaccaccggcggatcccggggctgctgggcttcctgagtccccagcggctctcaacacacacctatgtaccagagcatctattaaatgtgagccttgctttttatgaaaagctgtgctttgaaaac

SEQ ID NO: 179871 - DNA, 554 bp, Homo sapiens
  Payload ID: 15446
  Gene Symbol: SEPT12
  Gene Name: septin 12
  ENST ID: ENST00000591624
  CDS Start-End: 361-554
ctctctgccccccgtgggctcttcgcaccgctccctcccagccatcttccctgcctgaccttggtctctctctctctgtctccgtcaccttcatgcctgtgccgtctttctcgctctctatcaactctgctgtgtgtccccctggggaaagtgggggcacctcctcctgagccccctgcccaagtttcctgctgggacgggagccacttcaccccatacacactccctgaagcccctccaggactccagcctggctgcaaacacccatcctggactttgcctggccctccaggctctgctgggggaagcgacctgagaggcccctgcctgggctgtaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtggggcaaagcgggctgggcaagtccacgat

SEQ ID NO: 179872 - DNA, 618 bp, Homo sapiens
  Payload ID: 15446
  Gene Symbol: SEPT12
  Gene Name: septin 12
  ENST ID: ENST00000590741
  CDS Start-End: 96-269
ccccatcacacacaccaggccctgccaggacaaggcagctcctggaagctccaccaggacccacgtccaccaggcatctcgaacccttggcccccatggaccccctgaggcgctccccctctccctgcctgtcctcgcagccctccagccccagcaccccaccctgcgagatgcttggtcctgtgggcattgaggctgtgctggaccagctgaagatcaaggctatgaagatggggtttgagttcaacatcatggtggtgggtgagtgagagggcaaagcgggctgggcaagtccacgatggtgaacacgctgttcaagtccaaagtgtggaagtcaaacccaccgggcttgggggtgcccacaccccagacgctgcagctgcattcactgacccatgtcatagaggagaagggtgtgaagctgaagctgacggtgacggacacgcccggcttcggggaccagatcaacaatgacaactgctgggaccccatcctgggctacatcaacgagcaatacgagcagtacctgcaggaggagatcctcatcacccgccagcgccacatcccagacacccgggtgcactgctgcgtgtactttgtaccacccactgggcactg

SEQ ID NO: 179873 - DNA, 3785 bp, Homo sapiens
  Payload ID: 15447
  Gene Symbol: SEPT14
  Gene Name: septin 14
  Uniprot ID: Q6ZU15
  ENST ID: ENST00000388975
  CDS Start-End: 118-1416
acagtgaatatttatttggtccacaactggggacagtagaaaggacaccagcttggaatcagttcggacctgtgtctgctgcacagctgaatccctgggaaactcttttagtgtagcatggcagaaagaacaatggctatgcccacacaaatacctgctgatggagatacacaaaaagaaaataatattcgttgtttaactacgattggacattttggttttgaatgtttgcccaatcagttggtgagcagatctatccgacaaggattcacttttaatattctctgtgtgggggagactggaattggaaaatcgacactgatagacacattgtttaatactaacttgaaagataacaaatcctcacatttttactcaaatgttggacttcaaattcagacatatgaacttcaggaaagcaatgttcagttgaaattgactgttgtggagacagtagggtatggtgatcaaatagacaaagaagccagctaccaaccaatagttgactacatagatgcccaatttgaggcctatcttcaagaagaactgaagattaaacgttccttgtttgagtaccatgattctcgcgtccacgtgtgtctttacttcatttcacctacaggacattccctgaagtctcttgatctattaacaatgaagaaccttgacagtaaggtgaatattataccactgattgccaaagcagacactatttctaaaaatgatttacagacgtttaagaataagataatgagtgaattgattagcaatggcatccagatatatcagctcccaacagatgaagaaactgctgctcaagcgaactcctcagttagtgggctgttaccctttgctgtggtagggagtacagatgaagtgaaagttggaaaaaggatggtcagaggccgtcactacccttggggagttttgcaagtggaaaatgaaaatcactgtgacttcgttaagctccgagatatgcttctttgtaccaatatggaaaatctaaaagaaaaaacccacactcagcactatgaatgttataggtaccaaaaactgcagaaaatgggctttacagatgtgggtccaaacaaccagccagttagttttcaagaaatctttgaagccaaaagacaagagttctatgatcaatgtcagagggaagaagaagagttgaaacagagatttatgcagcgagtcaaggagaaagaagcaacatttaaagaagctgaaaaagagctgcaggacaagttcgagcatcttaaaatgattcaacaggaggagataaggaagctcgaggaagagaaaaaacaactggaaggagaaatcatagatttttataaaatgaaagctgcctccgaagcactgcagactcagctgagcaccgatacaaagaaagacaaacatcgtaagaaataatagtttctcttactattctgagagccctatcattctacatcgcaacttcctgtgagattgtctttgtagcatttaactctgaagttctcattttaaaaattggcttgcttattgtatattttccccaactaaagtgtgaactcctagcggggtgtggtggctcatgcctgtaatcccagcactttgggaggctgaggcgggtggaccacctgaggtcaggagttcaaaaccagcctgaccaaaatgatgaaaccctgcctctactaaaaatacaaaaattagctgggtttggtggccggtacctgtaatcccagccacttgggaggctgaggcaggagaatcacttgaaccccggaggtggaggttgcagtgagccaagatctcaccattgtactccagcctgggtgacaagagcaaaactccgcctcaaaaaaaaaaaaaaaaaaaaaagtatgaactcccagaaggcagatcctgtgtccctcttttcagattctgtatcttggcacttaggacgtacactaacacaaatatgactttcaatcaatatttgccaaaatgaaaaaacaaaagaaacacgtagcatcatgtaaaaggagctggttaggtggagaaatttatttaccatagtcctgcttttggatccagtagtgacttttaacttttatatccaaatagaagctggaggctttgttggggactcataggcataaaatgttaagttatacaaatctaattaataggcctattttcctttttaagttctactactgataatttcttgacagtttttatgataaaaggttggaatttgataagaactcccatgcttttgtgtcagacttaaaactgatattagaataaagaattcaaaagctagagaaagagttgcatttgaatgataatattatgtgttacagatttggggtatatgccaaagttatcaaagttgtagaaaataaggccaggtgtggtggctcacacctgtaatcccagcactttgggaggccgaggtgggcggatcacttgcggtcaggagcttgagaacagcccggccaacatgacgaaaccccatctctactaataatacaaaagttagccgggtgtggtgttgtgcacctgtagtccctgctactcggaaagctgaggcaggagaatcgcttgtagccaggaggcagaggttgtagtgagcagagattgcgccactgcactccagcctgggtgacagagcgctgagtcaccacacctggtataagccactgtgcctgacccacaatgacttttatacatattgttaaatcatcttacagattttataatttgggggaagaaaaattttactaaatgatcttttaatggaaactctacaagaaccagaatctttgctttgttcacttatgtatccattcctaggcctagaaaaatgtctgacgcatagcagcaattattcattgaataaatggacccagcaatagtacattagctatgccatatgcatacattaaaaatgtagattattgactttcaaaagataattaatgtaacttcttactgcttctgaacatgtttgtgagttatattgctgagggacctttatcttctcattctttcatcttaatccaatgttattaaaactgaaactgaaatcaccaatattattccatatttaaaaataacatctaccttataaaaattatcattgtgctgcatttgagaatagactttttaggtaataatggtataatccatagggtttttgagggcacagaaggattcatgctaacagaacattttattttctattttccaagagctataaaacatgatattatatgatactataaggcatatttttattttccataattttttctaaaaaaaattagtgttggttttccatataacttttaactttataagtaaatatttgtctctttcagctccagtttcatgtgaaatagagtttccagatttatgtagcatggaaagttttaatacgtcagttactgatttttgccagtcattttctcaattatttacttcttttatctttagttgattttttttgtagtgacaagttttgtttctattctcatttccttttgtgtatattctatgtagatttcgtttttggttactatgaaaattacatataacatcctggagttataacattctgatttgaatttatttcaacttaacttcaatcacataccaaaattctactgctatataggtctactctttttaggttattgatgtaacaaattgtatctttattcattgtacaccacctaacagatttataattacattttatgcatttgtcttttaaatcctgtagaaaataaaaagcggagttacaaacc

SEQ ID NO: 179874 - DNA, 3613 bp, Homo sapiens
  Payload ID: 15448
  Gene Symbol: SEPT2
  Gene Name: septin 2
  Uniprot ID: Q15019
  ENST ID: ENST00000360051
  CDS Start-End: 441-1526
gatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 179875 - DNA, 3315 bp, Homo sapiens
  Payload ID: 15448
  Gene Symbol: SEPT2
  Gene Name: septin 2
  Uniprot ID: Q15019
  ENST ID: ENST00000391971
  CDS Start-End: 140-1225
gacgcaatccgcctgcgcgctgggcggggcggggcgggctggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 179876 - DNA, 3701 bp, Homo sapiens
  Payload ID: 15448
  Gene Symbol: SEPT2
  Gene Name: septin 2
  Uniprot ID: Q15019
  ENST ID: ENST00000391973
  CDS Start-End: 529-1614
acctcgggccccacaccagaaggagaaagctaggggccgcgccagctccgccctcccccgcggggcggcgggccccagcccgggcacaggaaggccacgtccccggggagggacgcccgactcgatggtctgcgcagggcccgtcggccccacgtgacgtgcgcgcagccaatcccagagaggccccccgatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 179877 - DNA, 3267 bp, Homo sapiens
  Payload ID: 15448
  Gene Symbol: SEPT2
  Gene Name: septin 2
  ENST ID: ENST00000407971
  CDS Start-End: 212-1177
ggcggggcggggcgggctggggcgggctgtgagcggaccgcgagcgctgggcgggtccgcggcgcggtcggtcggcgcctgttctcgggctgtttggcggcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 179878 - DNA, 1734 bp, Homo sapiens
  Payload ID: 15448
  Gene Symbol: SEPT2
  Gene Name: septin 2
  Uniprot ID: Q15019
  ENST ID: ENST00000401990
  CDS Start-End: 447-1562
gggcggggcggggcgggctggggcgggctgtgagcggaccgcgagcgctgggcgggtccgcggcgcggtcggtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagggttcagtgaggctgaggggttctgtggaggtgcgggagaggtgctctatggtatttctatgttgcactgtgtgggtttgaaatcagatacatgtaataggtgataagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagctttgaacacaaggaaaacacttttatgggaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttg

SEQ ID NO: 179879 - DNA, 3333 bp, Homo sapiens
  Payload ID: 15448
  Gene Symbol: SEPT2
  Gene Name: septin 2
  Uniprot ID: Q15019
  ENST ID: ENST00000402092
  CDS Start-End: 158-1243
gctgggcgggtccgcggcgcggtcggtcggcgcctgttctcgggctgtttggcggaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatattaaa

SEQ ID NO: 179880 - DNA, 650 bp, Homo sapiens
  Payload ID: 15448
  Gene Symbol: SEPT2
  Gene Name: septin 2
  ENST ID: ENST00000407017
  CDS Start-End: 368-650
agtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattggtatgctcccccatgcccagggatctgcatttgtttacttaatatacttcataaatttatag

SEQ ID NO: 179881 - DNA, 644 bp, Homo sapiens
  Payload ID: 15448
  Gene Symbol: SEPT2
  Gene Name: septin 2
  ENST ID: ENST00000428524
  CDS Start-End: 494-644
agtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaat

SEQ ID NO: 179882 - DNA, 599 bp, Homo sapiens
  Payload ID: 15448
  Gene Symbol: SEPT2
  Gene Name: septin 2
  ENST ID: ENST00000449239
  CDS Start-End: 80-599
tgcgtatacatacatactatgtatgtgcgtttatgtgtgtctgtgtgttttttttttaacagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaaca

SEQ ID NO: 179883 - DNA, 561 bp, Homo sapiens
  Payload ID: 15448
  Gene Symbol: SEPT2
  Gene Name: septin 2
  ENST ID: ENST00000411484
  CDS Start-End: 121-561
gggctgtgagcggaccgcgagcgctgggcgggtccgcggcgcggtcggtcggcgcctgttctcgggctgtttggcggaggcttggaatagttaaatgactttggtcttgtccaaggttagatggagttcaactctaacgtcaagtcttggtccttttcattgcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttg

SEQ ID NO: 179884 - DNA, 1005 bp, Homo sapiens
  Payload ID: 15448
  Gene Symbol: SEPT2
  Gene Name: septin 2
  ENST ID: ENST00000428282
  CDS Start-End: 453-1005
aatcccagagaggccccccgatcatcgagacggcggcggtggtgggctagacgagtttcgcgcggccgctcgccgtcccccgcccagtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagatttta

SEQ ID NO: 179885 - DNA, 570 bp, Homo sapiens
  Payload ID: 15448
  Gene Symbol: SEPT2
  Gene Name: septin 2
  ENST ID: ENST00000457335
  CDS Start-End: 100-342
ggggcgggctgtgagcggaccgcgagcgctgggcgggtccgcggcgcggtcggtcggcgcctgttctcgggctgtttggcggacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactt

SEQ ID NO: 179886 - DNA, 558 bp, Homo sapiens
  Payload ID: 15448
  Gene Symbol: SEPT2
  Gene Name: septin 2
  ENST ID: ENST00000443492
  CDS Start-End: 196-558
cggtcggcgcctgttctcgggctgtttggcggacgaagcttcacaaaagatgtctaagtttgtttgttttttaatcttatttagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaag

SEQ ID NO: 179887 - DNA, 480 bp, Homo sapiens
  Payload ID: 15448
  Gene Symbol: SEPT2
  Gene Name: septin 2
  ENST ID: ENST00000434955
  CDS Start-End: 165-480
cgcgagcgctgggcgggtccgcggcgcggtcggtcggcgcctgttctcgggctgtttggcggaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatg

SEQ ID NO: 179888 - DNA, 801 bp, Homo sapiens
  Payload ID: 15448
  Gene Symbol: SEPT2
  Gene Name: septin 2
  ENST ID: ENST00000451310
  CDS Start-End: 1-88
agagatgattgcaaggatgcaggcgcagatgcagatgcagatgcagggcggggatggcgatggcggggctctcgggcaccacgtgtaaggtgatgtgcacatatcaagaagtcagagtgtgttttgttttcttttttctagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgct

SEQ ID NO: 179889 - DNA, 738 bp, Homo sapiens
  Payload ID: 15448
  Gene Symbol: SEPT2
  Gene Name: septin 2
  ENST ID: ENST00000425899
  CDS Start-End: 156-380
gcggtcggtcggcgcctgttctcgggctgtttggcggcatacagaaactgctgtaaaagaagaagttgtgggtatttttttttttttttttgtctggaggaatggggacaccaaaactcatttggcagcagaggtgagacgaagcttcacaaaagatgtctaagacgggagtcttgttctgtcaccaggctggagtgcagtggcatgatctcagctcactgcaacttctgcctcccacgttcaagcgattcccctggctcagcctccggagtagctgggactgcagacacgtgccaccacgctggctaattttttggattttagtaaattcggggtttcaccgtgttggccaggatggccttgatctgttgacctcgtgatccacccgctttggccccccgaagtgttgggattacagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagtttgtttcttttctagaaaaaattgaaagaactgtccagattgaggcttcaactgttgaaattgaagagcgaggggtcaagctacgcctgacagtggtagatacccctggct

SEQ ID NO: 179890 - DNA, 724 bp, Homo sapiens
  Payload ID: 15448
  Gene Symbol: SEPT2
  Gene Name: septin 2
  ENST ID: ENST00000429791
  CDS Start-End: 657-724
ccccgcacaagttgtgggccggccctcccgaggagctgcgggggacgcgccgctcgtcccatactctcgggcggtggtcggctggctctggggtgccggcggggcggtgtgggggaggggcggccgagcccaggctcttcggcacttatcgtgggctcccccgtcccgggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggtcgggaggtttggtgcttggagggaggatacaggtttaggcccgacaaacacttagagcttgtgtggccatcttgtctttctaacggtgccatttcctccctgaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacct

SEQ ID NO: 179891 - DNA, 575 bp, Homo sapiens
  Payload ID: 15448
  Gene Symbol: SEPT2
  Gene Name: septin 2
  ENST ID: ENST00000445030
  CDS Start-End: 359-575
agtcgtactcggcgccccagctcggtgctgccgccatcttcttggaggacaggaggagaggcgaaggctccccctccccgtgatcgctccgcactcccgccaccacctgccctcccgcgaccgcctctctcctcctcagtgggcacttgtctccttctaacaaacggccttccccccactccagttacccaccgcaaggcgaagattctcattacctgttccactcttataagcataagaaaaccgagctcataagaggcttggaatagttaaatgactttggtcttgtccaaggttagatggagttcaactctaacgtcaagtcttggtccttttcattgacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcag

SEQ ID NO: 179892 - DNA, 775 bp, Homo sapiens
  Payload ID: 15448
  Gene Symbol: SEPT2
  Gene Name: septin 2
  ENST ID: ENST00000436795
  CDS Start-End: 331-775
cgggctgtgagcggaccgcgagcgctgggcgggtccgcggcgcggtcggtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaaggtctgcaccagcgagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgtt

SEQ ID NO: 179893 - DNA, 818 bp, Homo sapiens
  Payload ID: 15448
  Gene Symbol: SEPT2
  Gene Name: septin 2
  ENST ID: ENST00000421717
  CDS Start-End: 1-567
gtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatgaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttcttt

SEQ ID NO: 179894 - DNA, 484 bp, Homo sapiens
  Payload ID: 15448
  Gene Symbol: SEPT2
  Gene Name: septin 2
  ENST ID: ENST00000457874
  CDS Start-End: 1-484
aatccccatggtatctttggagaacctacctctgtagagaggcagtagactctgaagtcacctgtcgtaagaacgtgagctttcctcttcacatgctgcttatattccctattaagtttgtttcttttctagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaa

SEQ ID NO: 179895 - DNA, 539 bp, Homo sapiens
  Payload ID: 15448
  Gene Symbol: SEPT2
  Gene Name: septin 2
  ENST ID: ENST00000420786
  CDS Start-End: 384-539
gggcggtcctagtgccggcgacagtggctccgacacgggcaggcccgggcgcgggagtggggattccggtgaccccttgttgaccctgcgggaattcctctgcactgtcgtcggtgctgggcctcggggcgtcgagtgcggtcgaggcgtggaggactggccagcccccaaacctccaagcccatcggctggatgccgtggataagcgaggggagagcgactaggccctgtctgcgggtaccttcggcgaggagaggcgacgaagcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgact

SEQ ID NO: 179896 - DNA, 574 bp, Homo sapiens
  Payload ID: 15448
  Gene Symbol: SEPT2
  Gene Name: septin 2
  ENST ID: ENST00000437066
  CDS Start-End: 182-574
gtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaaggtctgcaccagcgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcat

SEQ ID NO: 179897 - DNA, 372 bp, Homo sapiens
  Payload ID: 15448
  Gene Symbol: SEPT2
  Gene Name: septin 2
  ENST ID: ENST00000441533
  CDS Start-End: 158-372
gcgcggtcggtcggcgcctgttctcgggctgtttggcggcatacagaaactgctgtaaaagaagaagttgtgggtatttttttttttttttttgtctggaggaatggggacaccaaaactcatttggcagcagaggtgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagc

SEQ ID NO: 179898 - DNA, 3446 bp, Homo sapiens
  Payload ID: 15448
  Gene Symbol: SEPT2
  Gene Name: septin 2
  Uniprot ID: Q15019
  ENST ID: ENST00000616972
  CDS Start-End: 169-1359
gacgcaatccgcctgcgcgctgggcggggcggggcgggctggggcgggctgtgagcggaccgcgagcgctgggcgggtccgcggcgcggtcggtcggcgcctgttctcgggctgtttggcgggcgtggaggactggccagcccccaaacctccaagcccatcggctggatgccgtggataagcgaggggagagcgactaggccctgtctgcgggtaccttcggcgaggagaggcgacgaaggtctgcaccagcgagacgaagcttcacaaaagatgtctaagcaacagccaactcagtttataaatccagaaacacctggctatgttggatttgcaaacctccccaatcaagttcaccgaaaatcagtgaaaaaaggttttgagttcacactgatggtggtcggtgaatcaggtctaggaaaatcgactctcataaacagcctattcctaactgatctgtacccagaaagagtcatacctggagcagcagaaaaaattgaaagaactgtccagattgaggcttcaactgttgaaattgaagagcgaggggtcaagctacgcctgacagtggtagatacccctggctatggtgacgctatcaactgcagagattgttttaagacaattatctcctatattgatgagcaatttgagaggtacctgcatgacgagagcggcttgaacaggcggcacatcattgataatagggtgcattgttgcttttactttatttcaccttttggacatggacttaagcccttagatgtggcgtttatgaaggcaatacacaacaaggtgaatattgtgcctgtcattgcaaaagctgacactctcaccctgaaggaacgggagcggctgaagaaaaggattctggatgaaattgaagaacataacatcaaaatctatcacttacctgatgcagaatcagatgaagatgaagattttaaagagcagactagacttctcaaggctagcatcccattctctgtggttggatccaatcagttgattgaagccaaaggaaagaaggtcagaggccgcctctacccctggggtgttgtggaagtggagaacccagagcacaatgactttctgaagctgagaaccatgctcatcacccacatgcaggatctccaggaggtgacccaggaccttcattatgaaaacttccgttctgagagactcaagagaggcggcaggaaagtggagaatgaggacatgaataaagaccagatcttgctggaaaaagaagctgagctccgccgcatgcaagagatgattgcaaggatgcaggcgcagatgcagatgcagatgcagggcggggatggcgatggcggggctctcgggcaccacgtgtaaggtgatgtgcacatatcaagaagtcagagaaaacactttcctggataaaaaagaaaacattccagatgcatgatccagctgtgtgttttcaatccttgggagggtgccatccacattttaacagtacctgtgcctgagaatttaatttttaaaagactttgatgtgtttttgtatgaagtacttttaacgtatgtatttcattgctgtgtcacactctgtgttttgtgaggtgaatgtcttccttttctttctccctaaccactaatgttagaattgatttccaagaatcggcatgtatacttaatactgaatttctttgatttaactgacttaacaactgactaaccattgatgagcactcctgatttttatctagaacattcagatttaccataatgttccttagtggtagaggtgtgtgcctagtgatgtagaaagatacactgacttggtgcaaggccatctgcttaccacatcacaccacttggagatctttgcttccttgcttttatgtttgtacacaacacctaaaaccagttttgctgctataattctatactgttgattcgtctgcgattttatctgttaaccaaataaaacataatagaatttcctaatgagatatatctttatacttaaacagcttttttagaggtgagttttaaagaagtctcttaattctgatgctaggttgtttttaaaaccactatgcaaagaactcaccacaagccaccttttgtagtgttctccactaatactggttatcctgtgctacagagaaaatcaaagcagtcataagctccagttttcgtattgcaaataagactcttacctacaaaatgagattcagtgaactaatttggtttttactcaaccaaattaaaaatttttttaaggaaaattagcagttggtctattcagaatcaaacctttttatattttatactgcactttagtgtattttctgtcactgtaggtatagaagatctgcctcccctgtggaaattggggtctgttggtgggcgtgcccctgaagcctggcttgggttgaaaagtgttcccgccctaaggccttggtgccctgaacctctgatgcctaccgggttctcctgatttgagtttcctttaaatactccctttttgagtaattttctgatgggaggaaagtagcagtcatcatctttttgtgtgcaggctgtctcatttatttttagccattgtcgtttcattcattttgtgtaatataaaccgtgtgtcatgtcaaagtgaaagacatttcaaatctgtagcataggctagtgggcaggtccgcacagtcgaagccacacctggtctgttttctgtgcactgtagccttagtgtcacctttcttcttgtgtctccttatggtacactccagcggttgccttttttatcatttctactgaagttgggaaattcaaccccagaaattgacagatgaaaggagacaatggttgtgtagggagatggagaaaatgcttaatctgaggatgagacagggttttttcatttttgtgggggctagaaaaaacataaaatgaggcagttaaataataatagttaatgaaggtgtgctacagaaaataatctggtgttcttgctaactttgcccttcactgttgcttaattgtgaacagccaaaagctatatgttatggcttattgtgtgaaggtaactaagaagtggtgttccatgacttcagagtacatccatgcggagtccattatttgagtttgacatttaataactttgctggaaaatctgtaaaaaagaaaaacaagtttgctagtgactaagccccgcatatgtgagtgaaagtacttcaggcacgctgcctcctggtaacagctatgcagggagggaggacccacactgctacacttctgatcccctttggttttactacccaaatctaaatagatacttttgataatagataactgctcttttactaagacatagtctctacctatagaaatgtattttgaaaacacttattttacacagcaattttgtatccatttaaactaaccttttatcaataaagcactattgtttagatatt

SEQ ID NO: 179899 - DNA, 1896 bp, Homo sapiens
  Payload ID: 15449
  Gene Symbol: SEPT3
  Gene Name: septin 3
  Uniprot ID: Q9UH03
  ENST ID: ENST00000396417
  CDS Start-End: 16-267
gacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaac

SEQ ID NO: 179900 - DNA, 4649 bp, Homo sapiens
  Payload ID: 15449
  Gene Symbol: SEPT3
  Gene Name: septin 3
  Uniprot ID: Q9UH03
  ENST ID: ENST00000396425
  CDS Start-End: 132-1184
tgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccggtgagcgtggacacagaggaaagccacgacagtaacccatgacgaccacttctctgtgtcatcacacatacccacttcacacacacacatcccaaataccaccaccaaccaccttcttcctctcaactctgtcccacaggcctgtctggtatttgtggagcatcttgtctgtgtgtgtgtgtgtgtgtgtgtgtgtgtgtgtgtgtgtgacagagagagagcgagagagcctgtgtgtgtgcatgcaggggtgaggtattttcactgccctccctggagagtcccttgtaagtttggctcctccatgcctgtccattatctgtctcctttccttgtgtcccaaaacaaagctgtttgcctcactcaggagatctgggggaggtttcatttaaaagtgctgggagcaggtgagccacaggcaactcttctctcggaacctgcacacaaactggggctatagagattctccaaggacagatggcagtggagctagacctgagtagggggcagggagttcaggacaaccctcctgtaagttgggggtggtctgggggtaaggctggggcttcctgggaaaaggaaggccatgagaaggcagagaagtaggccagagctgggttcttgcagaaagcatcagtgcctacaaatggagctccacccttcagtctgtgtcgtgttcagtgtcacaaagctaccacctgtcaccagagcctactgctgctctccactcaactggcctctgctgccaggccactgcctgtctctgcttccgactttgtcttctttctccctttccctccttccctcatacattgctttctctccctctcctgcgtgtctctgacatctctcacttccttttagatgaatctactttaggttcattcctatatttagcatttatgcccagtctacttccagaaatgactttagactgcctttcacataaaatcacaaaactacaggacagtacaaacagattgccagagaaatctgggtcaaagaaaggaataggaaagaaagtttctgtagtcaagcacctgaacaggccctgagctcacaggcagccaatgtaaagagggaaacacagtgagttatgcagttcccagtgtccagttaaaggaagcacacatgctagtcatgtgagacaaccttttattgggacatcaggttctagaactaattctaaagaagtatcagaaacaatatacataatttgtctttcttagtaatttggcttcaaagacaaatttttgaccacacctccgttttctccgtcagacttctctcccttctaagcaggcttctctgttgctccatttgcttcatacatacttgacctctcttttctattccccatcacttttgtgctgaagctaatcatatttatgtctgtctttctctacttttccctaattccctctcctcctgactcctgtagacattcccaatgatacccaccgtcatacatttaggcttttcttgcctttccctgaagccctgtatttattaatgcatatatttcccctgcttgttgtacaagtaagttactcttttcctttaatctgtaagattcatgaaattcggggccagggaaacagtttagccttagggaagggaaaacactaagtgaaactgtttacaataacctcatacaaccttctgtcccatctcctggttcagcctaggtgtttcactggtcctctatgaatcccagcacttataatcccagtcttttatcactcaggtgctaggaaaaaaaacatagactcaagacccaagattcaatggaccaggagaaaggggggcggtgatcaggtcaccagtgaccccaacctatgctctcggtctttcctggaggctgccaacccagccctcatcctcccttgctcacaaagttacagggtaggcacctgtcaggacagaacagcagcagcgctacagcccagaggttatacatttcaacagaacagggatccttggctactgtagaagcagtcctgtatggagaccttggaccagcaggggaagatctatgggcatgggaggtgggcgttggaaaggctgagtaggaatggtgcctggcacccctgaaccatgatctgagcctccctggagaaggtattttatatgtctgctgccagctgctggtctccacaccctcaaccgttctcaacccccctgcagggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 179901 - DNA, 2586 bp, Homo sapiens
  Payload ID: 15449
  Gene Symbol: SEPT3
  Gene Name: septin 3
  Uniprot ID: Q9UH03
  ENST ID: ENST00000396426
  CDS Start-End: 256-1332
ggcggcggcaacggtgcgcgcggacaggggcggcgcggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaagggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagcaataagagggatctcttcccacctaccctacctactcctacccccaacccccttccccattaatgtgagtaatgaattagcctgaccacaggtggtcactgtaggctaatggaaaatacccaagggagggcaaagccccccatcagatgcatgaatgtttgcgaatgttgactgccactgccccacacactgtgtctttatagaattcccctttgcccaccctcttcctgtctccacctggacacaacttgctcaaaggctggtgacttgtgggccattcatctacaaccaagtcctgatggagcaagaggcccacgcctaggggatgcaagaacaacccgtttcttaaatgttaccagtcccagccaatcttacggtgacattacagttaaatttcccaattgaaaacaagcaaacagacactcaaactggtcctgtaattgttgctagactttatgtgttgtacaactaaacattgctgtttgaacagtaa

SEQ ID NO: 179902 - DNA, 1866 bp, Homo sapiens
  Payload ID: 15449
  Gene Symbol: SEPT3
  Gene Name: septin 3
  ENST ID: ENST00000406029
  CDS Start-End: 221-1105
cggcgccgagcgagccgaggcgaggtcccggggagggcgcggcggcgcggggcgcaggggcggcgcggcggggccgcgggccgggcgggtgggaggagagcgcgaaggggcgaggcccgtttgcaggggccgctcggcccggggaagcccgcgccccgctcagccttgcagccccgcgcccggagcatctccctggaggaacggagacaaaggaggattcatgtccaaaggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagttcatgaaacacctcagcaaggttgtgaacatcatccctgtcattgctaaggctgacaccatgaccctggaggagaagtctgaattcaagcaaagggttcgcaaggagcttgaagtaaatggcattgaattctacccccagaaggaatttgatgaggatttggaggataagacggagaatgacaaaatcaggcaggagagcatgccttttgctgtggtgggaagtgacaaggagtaccaagtgaatggcaagagggtcctcggccgaaaaactccatgggggatcatcgaagtggaaaacctcaaccactgtgagtttgccctgcttcgagactttgtcatcaggacccacctccaggacctcaaggaagtgacacacaacatccactatgagacttacagggccaagcggctcaatgacaatggaggcctccctccgggagaaggcctcctgggcactgtccttccacctgtgccagccaccccctgccccactgctgaatgaaggccatttcaagcgctgcttctcactccattcctctcagctgttattgctgcagggccaagccctttttagtgctgtgctcgtccagctcaccaccacagcccctctcagccctcagtaggtgggaggggccagctgcctctttaggccagttgcatcctccatttatccaaaccactcctctcctcccagtggagtggggttctgccagtacagccctactgcatcatctgcgtcagccggtcctagcccatctgcagggtgaaagaactcatcaagagctccttctgcccttgtaagcccatcccagctacttgtaaccatctctaagggcaatggcattgctccctacccattcatctgcatgagctactcttggcttccttaaagggtcaagaaagcaatttttctgcttactagattcattgagatcagctgtgtgagccccaaagtgggacaagggtgtctccttcattacttaaagatattcatgagggtgggtcactacagatgttggggagcaagggctaggatcactttttaaaaaatcaccacttgtggctgtcccagagtgcggttgtacatcctccccacctcataacgcagccactgaggaagagtggttttcctaagaagacattgctggagttgactttcttctgtccaaacaaacaaacaaaaactaaacacacacacaaacccccagaaacccacaatatgtacacgctaaggaaaaactagcacccttctgtccactcagc

SEQ ID NO: 179903 - DNA, 876 bp, Homo sapiens
  Payload ID: 15449
  Gene Symbol: SEPT3
  Gene Name: septin 3
  ENST ID: ENST00000449288
  CDS Start-End: 342-876
actagacccagaaccttcgaggggagggatggttgtcctcacccctgtgaggcaatatgctgtccattagtatccactgaatgcgtgaaatttttttctaatgggcaaactgaggctcagagaagttcctgtctggctcaaggttattggttcatcattctggagcagggcctggaacccgggcccctgactcggctctacaggcacccgcgcaacaccccagcccccgcgtgactcacgcgcgctcacggccgcccgcagctgccactggtcccctgcgcccctccgcccgtccccgccgcagcccagtggggctcccagagaccaggacggacgcagccatgtcagagctggtgcctgagcccaggcctaagccagcggtgcccatgaagcccatgagcatcaactccaacctgctgggctacatcggcatcgacaccatcatcgagcagatgcgcaagaagaccatgaagaccggtttcgacttcaacatcatggtcgttggccagagtggactgggcaaatcaacgctggtcaacacgctcttcaaatcccaagtgagccgcaaggcctccagctggaaccgggaggagaagatccccaagacagtggagatcaaagctatcgggcatgtgatagaggaaggcggtgtcaaaatgaagctgaccgtcatcgacaccccaggctttggagaccaaatcaacaatgaaaactgctgggagcccattgagaagtacatcaatgagcagtacgagaagttcctgaaggaggaggtcaacatcgccaggaagaaacgcatccctgacactcgtgtccactgctgcctttacttcatctctcccacaggacactccttgcgacctctggatcttgagt

SEQ ID NO: 179904 - DNA, 1530 bp, Homo sapiens
  Payload ID: 15450
  Gene Symbol: SEPT4
  Gene Name: septin 4
  Uniprot ID: O43236
  ENST ID: ENST00000317256
  CDS Start-End: 84-1463
ggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagca

SEQ ID NO: 179905 - DNA, 1784 bp, Homo sapiens
  Payload ID: 15450
  Gene Symbol: SEPT4
  Gene Name: septin 4
  Uniprot ID: O43236
  ENST ID: ENST00000317268
  CDS Start-End: 178-1614
caggcttttttggcccctgccagagacagaagggggtcaaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 179906 - DNA, 1556 bp, Homo sapiens
  Payload ID: 15450
  Gene Symbol: SEPT4
  Gene Name: septin 4
  Uniprot ID: O43236
  ENST ID: ENST00000393086
  CDS Start-End: 1-1380
atgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 179907 - DNA, 1795 bp, Homo sapiens
  Payload ID: 15450
  Gene Symbol: SEPT4
  Gene Name: septin 4
  Uniprot ID: O43236
  ENST ID: ENST00000457347
  CDS Start-End: 146-1627
acttgcactaggaagggattgggccaggtttgcccaagtccactgggcatctttagtaaatttctctttttctcctcctattggcactctctgaattccatttgctgccccctgggaatgcctggcttctactctgttatgacagatgaggagctctccagccctgttcagcagcagagctgctccccagaagccaagaaaagaaggctcccaagcagctgggctgctggtcttctctgactctctggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtg

SEQ ID NO: 179908 - DNA, 1906 bp, Homo sapiens
  Payload ID: 15450
  Gene Symbol: SEPT4
  Gene Name: septin 4
  Uniprot ID: O43236
  ENST ID: ENST00000426861
  CDS Start-End: 88-912
cggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaagtatgaccagaagccaggacaaagctggcagggggagatcccaagcctagccttgggtgagaccaagccctacttttgttcttctataggccctgggctcaatctaagcgggtgctggggtcctcctcgccttatcaacccttttctccctttagcaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggct

SEQ ID NO: 179909 - DNA, 1597 bp, Homo sapiens
  Payload ID: 15450
  Gene Symbol: SEPT4
  Gene Name: septin 4
  Uniprot ID: O43236
  ENST ID: ENST00000412945
  CDS Start-End: 118-1530
acttgcactaggaagggattgggccaggtttgcccaagtccactgggcatctttagtaaatttctctttttctcctcctattggcactctctgaattccatttgctgccccctgggaatgcctggcttctactctgttatgacagatgaggagatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagca

SEQ ID NO: 179910 - DNA, 632 bp, Homo sapiens
  Payload ID: 15450
  Gene Symbol: SEPT4
  Gene Name: septin 4
  ENST ID: ENST00000581615
  CDS Start-End: 140-307
aaagagaaagggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctgggatcaagcgtttcctggaggacaccacggatgatggagaactgagcaagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacat

SEQ ID NO: 179911 - DNA, 508 bp, Homo sapiens
  Payload ID: 15450
  Gene Symbol: SEPT4
  Gene Name: septin 4
  ENST ID: ENST00000578131
  CDS Start-End: 103-213
gaggcgggagggtgacggcggtgctgcgaggtcggcgcgcagctccgccgcgggtcgctcgggcgctgtccaggcggagccggccccgcccgggctgcagccatgatcaagcgtttcctggaggacaccacggatgatggagaactgagcaagatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccg

SEQ ID NO: 179912 - DNA, 1396 bp, Homo sapiens
  Payload ID: 15450
  Gene Symbol: SEPT4
  Gene Name: septin 4
  ENST ID: ENST00000580844
  CDS Start-End: 130-1269
ggaaaggagcaagccaggaagccagacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcc

SEQ ID NO: 179913 - DNA, 789 bp, Homo sapiens
  Payload ID: 15450
  Gene Symbol: SEPT4
  Gene Name: septin 4
  ENST ID: ENST00000583291
  CDS Start-End: 113-789
cgcactcggggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtg

SEQ ID NO: 179914 - DNA, 724 bp, Homo sapiens
  Payload ID: 15450
  Gene Symbol: SEPT4
  Gene Name: septin 4
  ENST ID: ENST00000577729
  CDS Start-End: 104-724
ggaggcgggagggtgacggcggtgctgcgaggtcggcgcgcagctccgccgcgggtcgctcgggcgctgtccaggcggagccggccccgcccgggctgcagccatggggccagtaccaacttcatttggaaaacgcagaggaggcccacaaacactgcctgcctcaccaggagggatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccac

SEQ ID NO: 179915 - DNA, 1709 bp, Homo sapiens
  Payload ID: 15450
  Gene Symbol: SEPT4
  Gene Name: septin 4
  Uniprot ID: O43236
  ENST ID: ENST00000583114
  CDS Start-End: 538-1533
gacaatgagagttgggggaaacagttcctcttctgagctgaggatggggtagaacaggcttctacagaggagtcagtccattctctgccttccactccctgtgggtcatggttcaggccaggccctctcgtgcactgccggctctgggcagaggggatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagtacttctgtgccccagcccctctcagcccatctgccaggccccgcagcccatggggcaagcttgatccctatgattcctctgaggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaacaaactgactcgggaaagtggtaccgacttccccatccctgctgtcccaccagggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggcttctgg

SEQ ID NO: 179916 - DNA, 676 bp, Homo sapiens
  Payload ID: 15450
  Gene Symbol: SEPT4
  Gene Name: septin 4
  ENST ID: ENST00000581607
  CDS Start-End: 460-676
gggcgggcgcggggcagggctggggtgcgcagggccggtcgctcccgggcggctgcaaggggacccgcggcaccgcagccgcggctgtgcagggtgggaggcgccgtcgccggccccgggcacaggctggcactgctgccgggcggcggtgcgtcgctgctcccaagtttttccctctgagcagccacggagtgggcgccaacccctgggtgatgcctgcgctctaggacgaaggggtgggtccgtgctgagggaggtgcccgctggtggagacgcgcttgttgggctggggaaggcgcatcagtaataagcggaggtgagggtccccatcctcgcctgggtcagcttttacctgagtaacccctcctcacccacctaccctgggcacaggggccagtaccaacttcatttggaaaacgcagaggaggcccacaaacactgcctgcctcaccaggagggatgatcaagcgtttcctggaggacaccacggatgatggagaactgagcaagttcgtgaaggatttctcaggaaatgcgagctgccacccaccagaggctaagacctgggcatccaggccccaagtcccggagccaaggccccaggccccggacctctatgatgatgacctggagttcagacccccctcgcggccccagtcctctgacaaccagcagt

SEQ ID NO: 179917 - DNA, 1362 bp, Homo sapiens
  Payload ID: 15450
  Gene Symbol: SEPT4
  Gene Name: septin 4
  ENST ID: ENST00000579371
  CDS Start-End: 106-1104
gacaacaacagcatcaaaacaaggctgtttctgtgtgtgaggaactttgcctgggagataaaattagacctagagctttctgacagggagtctgaagcgtgggacatggaccgttcactgggatggcaagggaattctgtccctgaggacaggactgaagctggggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggctccggccattggatgttgaattcatgaaggccctgcatcagcgggtcaacatcgtgcctatcctggctaaggcagacacactgacacctcccgaagtggaccacaagaaacgcaaaatccgggaggagattgagcattttggaatcaagatctatcaattcccagactgtgactctgatgaggatgaggacttcaaattgcaggaccaagccctaaaggaaagcatcccatttgcagtaattggcagcaacactgtagtagaggccagagggcggcgagttcggggtcgactctacccctggggcatcgtggaagtggaaaacccagggcactgcgactttgtgaagctgaggacaatgctggtacgtacccacatgcaggacctgaaggatgtgacacgggagacacattatgagaactaccgggcacagtgcatccagagcatgacccgcctggtggtgaaggaacggaatcgcaaggacagatccagaaactgagaagcttatccgagagaaagatgaggagctgcggcggatgcaggagatgctacacaaaatacaaaaacagatgaaggagaactattaactggctttcagccctggatatttaaatctcctcctcttcttcctgtccatgccggcccctcccagcaccagctctgctcaggccccttcagctactgccacttcgccttacatccctgctgactgcccagagactcagaggaaataaagtttaataaatctgtaggtggc

SEQ ID NO: 179918 - DNA, 952 bp, Homo sapiens
  Payload ID: 15450
  Gene Symbol: SEPT4
  Gene Name: septin 4
  ENST ID: ENST00000580809
  CDS Start-End: 92-619
gtgacggcggtgctgcgaggtcggcgcgcagctccgccgcgggtcgctcgggcgctgtccaggcggagccggccccgcccgggctgcagccatggatgacaaggagtatgtgggctttgcaaccctccccaaccaagtccaccgaaagtccgtgaagaaaggctttgactttaccctcatggtggcaggagagtctggcctgggcaaatccacacttgtcaatagcctcttcctcactgatctgtaccgggaccggaaacttcttggtgctgaagagaggatcatgcaaactgtggagatcactaagcatgcagtggacatagaagagaagggtgtgaggctgcggctcaccattgtggacacaccaggttttggggatgcagtcaacaacacagagtgctggaagcctgtggcagaatacattgatcagcagtttgagcagtatttccgagacgagagtggcctgaaccgaaagaacatccaagacaacagggtgcactgctgcctgtacttcatctcacccttcggccatgggtatggtccaagcctgaggctcctggcaccaccgggtgctgtcaagggaacaggccaagagcaccaggggcagggctgccactagcaggtggtcacaggttcctgttccccaggctccggccattggatgttgaattcatgaaggccctgcatcagcgggtcaacatcgtgcctatcctggctaaggcagacacactgacacctcccgaagtggaccacaagaaacgcaaagtgagggaagctggtggtgggaggggatcaggtgggcttctagaaaggatgtggtccccagaactgtgggcccctcatctgtttgtcagatccgggaggagattgagcattttggaatcaagatctatcaattcccagactgtgactctgatgaggatgaggacttcaaattgcaggaccaagccct

SEQ ID NO: 179919 - DNA, 1588 bp, Homo sapiens
  Payload ID: 15451
  Gene Symbol: SEPT5
  Gene Name: septin 5
  ENST ID: ENST00000383045
  CDS Start-End: 307-1443
cgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattg

SEQ ID NO: 179920 - DNA, 794 bp, Homo sapiens
  Payload ID: 15451
  Gene Symbol: SEPT5
  Gene Name: septin 5
  ENST ID: ENST00000395109
  CDS Start-End: 255-794
atctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgag

SEQ ID NO: 179921 - DNA, 1974 bp, Homo sapiens
  Payload ID: 15451
  Gene Symbol: SEPT5
  Gene Name: septin 5
  ENST ID: ENST00000406395
  CDS Start-End: 86-1099
ccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggagggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaat

SEQ ID NO: 179922 - DNA, 1996 bp, Homo sapiens
  Payload ID: 15451
  Gene Symbol: SEPT5
  Gene Name: septin 5
  ENST ID: ENST00000406172
  CDS Start-End: 61-807
ccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 179923 - DNA, 2070 bp, Homo sapiens
  Payload ID: 15451
  Gene Symbol: SEPT5
  Gene Name: septin 5
  Uniprot ID: Q99719
  ENST ID: ENST00000455784
  CDS Start-End: 126-1235
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 179924 - DNA, 4113 bp, Homo sapiens
  Payload ID: 15451
  Gene Symbol: SEPT5
  Gene Name: septin 5
  ENST ID: ENST00000455843
  CDS Start-End: 1519-2655
gttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgc

SEQ ID NO: 179925 - DNA, 2241 bp, Homo sapiens
  Payload ID: 15451
  Gene Symbol: SEPT5
  Gene Name: septin 5
  Uniprot ID: Q99719
  ENST ID: ENST00000438754
  CDS Start-End: 281-1321
tggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggagggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtc

SEQ ID NO: 179926 - DNA, 3173 bp, Homo sapiens
  Payload ID: 15451
  Gene Symbol: SEPT5
  Gene Name: septin 5
  ENST ID: ENST00000431044
  CDS Start-End: 191-1159
cgggagcggggcctgcccggactgcgacgccgccacagcttggggccagttcgcccagtcagggggatggctcggtcggcctcgggggtcgacgatcccccgggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaaggatgaggaactgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccgggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggt

SEQ ID NO: 179927 - DNA, 318 bp, Homo sapiens
  Payload ID: 15451
  Gene Symbol: SEPT5
  Gene Name: septin 5
  ENST ID: ENST00000413258
  CDS Start-End: 1-318
caccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatggtgagatccggaagctgaaggagcggatccgggaggagattgacaagtttgggatccatgtataccagttccctgagtgtgactcggacgaggatgaggacttcaagcagcaggaccgggaactgaaggtgaa

SEQ ID NO: 179928 - DNA, 1108 bp, Homo sapiens
  Payload ID: 15451
  Gene Symbol: SEPT5
  Gene Name: septin 5
  ENST ID: ENST00000412544
  CDS Start-End: 205-1108
ccgccgcccgcgcgcctctcaccgtgtctctccgtctctcccccgcccgccggcccggacccgctcggaaccggacccggactcgaccccgaccccgaccccgcagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccctgggggatcgtggaggtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccagcaaactgacccaggacagccgcatggagagccccatcccgatcctgccgctgcccaccccggacgccgagactgagaagcttatcaggatgaagg

SEQ ID NO: 179929 - DNA, 920 bp, Homo sapiens
  Payload ID: 15451
  Gene Symbol: SEPT5
  Gene Name: septin 5
  ENST ID: ENST00000431124
  CDS Start-End: 9-920
caggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgtgggtttcatgaaggcattgcatgagaaggtcaacatcgtgcctctcatcgccaaagctgactgtcttgtccccagtgagatccggaagctgaaggagcggatccgggaggagattgacaagtttgggatccatgtataccagttccctgagtgtgactcggacgaggatgaggacttcaagcagcaggaccgggaactgaaggagagcgcgcccttcgccgttataggcagcaacacggtggtggaggccaaggggcagcgggtccggggccgactgtacccc

SEQ ID NO: 179930 - DNA, 662 bp, Homo sapiens
  Payload ID: 15451
  Gene Symbol: SEPT5
  Gene Name: septin 5
  ENST ID: ENST00000622227
  CDS Start-End: 126-662
ggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccagaggacaagcaggacattgacaagcagtacgtgggcttcgccacactgcccaaccaggtgcaccgcaagtcggtgaagaaaggctttgacttcacactcatggtggctggtgagtcaggcctggggaagtccacactggtccacagcctcttcctgacagacttgtacaaggaccggaagctgctcagtgctgaggagcgcatcagccagacggtagagattctaaaacacacggtggacattgaggagaagggagtcaagctgaagctcaccatcgtggacacgccgggattcggggacgctgtcaacaacaccgagtgctggaagcccatcaccgactatgtggaccagcagtttgagcagtacttccgtgatgagagcggcctcaaccgaaagaacatccaagacaaccgagtgcactgctgcctatacttcatctcccccttcgggcatgggctgcggccagtggatgggtttcatgaaggcattgcatga

SEQ ID NO: 179931 - DNA, 2693 bp, Homo sapiens
  Payload ID: 15452
  Gene Symbol: SEPT6
  Gene Name: septin 6
  Uniprot ID: Q14141
  ENST ID: ENST00000343984
  CDS Start-End: 266-1570
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaataatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctgg

SEQ ID NO: 179932 - DNA, 1576 bp, Homo sapiens
  Payload ID: 15452
  Gene Symbol: SEPT6
  Gene Name: septin 6
  Uniprot ID: Q14141
  ENST ID: ENST00000354228
  CDS Start-End: 266-1555
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaactttttttaatcttgtcttcagcagctgcac

SEQ ID NO: 179933 - DNA, 4652 bp, Homo sapiens
  Payload ID: 15452
  Gene Symbol: SEPT6
  Gene Name: septin 6
  ENST ID: ENST00000354416
  CDS Start-End: 266-1561
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaatttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagctttaaa

SEQ ID NO: 179934 - DNA, 2609 bp, Homo sapiens
  Payload ID: 15452
  Gene Symbol: SEPT6
  Gene Name: septin 6
  Uniprot ID: Q14141
  ENST ID: ENST00000360156
  CDS Start-End: 266-1549
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgctttttttaatcttgtcttcagcagctgcactaagtctaaaggagaagactgccattatagaagagttagggttccatattgtctcaaatcagaaatcaaccaatttcctctcccctcaaactgcaagcacacacacatacaccacaccactcaacaagtgttcatgtgtccctgtgtccaggcaagaagctctcttcctgactcacatggtattttaaatggaagtgtcttgtcctaactaacaaggcaggaaaagaaccatcagagctggaaaatggacgaaatgtaacctcagagaaacaactacaggaccactcacccaagtgtaagtgactggggcaggacacctcagctgtgggtatgaaagtactgttctgttcacaaggttttgtttgagttttatgtttttcttttaaacatttctctggttcgatgggttgactgtctacagccactgttaaacatttctgaatatgcaagagaaagtcaagtgacatttgtatcttcttcagcattcgcagaccttctatagattccagcaaagggggaaaatgtatccactatctaacacttaggtagagaagggagggggtttaagcttagtgagggcaaaattactccattccaccttccgagaccagttagggttttgagagaggtttctgctcaacctgggatctggagggagagctttgatgttggtaaatctgccttgaattcattggtttaacttgcatcaaaataccatgtgagtgtgctcattctcatatatcccctaccaccatcaccaccattctgctgttcagtgtctcttgagagagcctctttgcatgttttccagaatctgtgtgtgtttttcctttcttctcctttgttctttttgctcaaaggtgtgaccagtcattgcccctctggggctttcattctccaggagaaacatcccagaaccagcactgtttagcctgatacctttctaatgtccatgtcaattttcaataaaattcaaagaaatgctaaa

SEQ ID NO: 179935 - DNA, 4694 bp, Homo sapiens
  Payload ID: 15452
  Gene Symbol: SEPT6
  Gene Name: septin 6
  Uniprot ID: Q14141
  ENST ID: ENST00000394610
  CDS Start-End: 266-1549
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtttgggcttcctgtagacacccttttcctgcgcaacagagctgggcctccctttctctaatttcccccttaacatgcctggggggcatacaatccaacccgcgccctctcctctcttcctgccaaggtttatagaaacctgagaatctgagggtgatgtctggccgctggtcaagaagccaacagtcatgtggctcgcagatgcatcctgcatcccagtccccctcccagcacccccagccatcccccctgtcttcccccacatctttgccagaggtgtgacatggtcagggggcccatctgctactctttcccaccagctcccctgttccagttctggttgctgttagtttccctgaggtatttgcaaccaccatggctgggtaaccaccgatcagcacagctgtccccttggtctcctgtatcccagtcactagtcctccctggtccaccccaccctcatcctcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagggagaataaacctgaatattattaccagcctagagtcttgaatgatagccttaccgaattcttcttgtgaggtatttcagcatctcggggggtaatttccggaagggctccatactgtcccaataaggtgaggccagtagcaggaataataaatcccactttgtaggctggaaaactgagctgtcaaaagaatcaagtgtttgggggtttgctctgatgagtcttctagttcatttggtgaatgtcatgatgatttttaacatgcattttgcatgcatcccccaataagaagagatgagactcggccggagagaagaaaaggcccttaactttctttccaatttaaggagttgagagtttaaaaatattccagccctaagtttttatcatgggtcccatctgatagtggctttgggaacctctgtgaagtagagagccctcccttgtcagggttatgaggcacagtggcctttggtgtttggccagtgacagtgtgagagatggagttgacctggcaatgatctgtggctaacatgccgtctctctgcccttcctttgcagtaatccatggctgtgtactgaatagtattccccgctacagctggactggactccatttagccttttaagccgaggttcctattttaactgacagctttcctttggggtgccaggcagcgaggccccccacccctatcctgccatgtacttcaagctcacttcttctttttgagttccgcaacttgctcctgcctcccagccccactggcactgaccatgaccacctacttctattttttttttagagtttctttttttgatcacttactttcaaagcacacagtcaaacaaggttatgccaaatttccaggcctttttgaagtattgagaaggggaaggggatttctcacttcaattatagatcataataggaagcaaaaagaaaaaaatgaaaagcaaacatatgcacgcacttttcttgttgacaaagcaagaatataggtttgctgtgtaggtttggtgctctattgattggtgagtgaccagagcaagtatgaaggtgatgctgccaaagcacaagccagtttcttgggaaaattcaagttacagtggagtatttttttgaagaccatatgcttggaggtagaaacaaaccaacgaccaaaaaaaaaaaaaaaaaaatctgctcagatactcagccagtagctcagagagatgctgagttaggcctgtcaggtctccttgggaaaggcttcatatttgcaactttgatgattctatgtccagcttcagagctgctttcccagaaattcacgcttaaacaaccaaccggtaaccaccacttccccacaccgccgcccggtaattatttgcattacaaaccggaggcgccctcatttgcatttgtgtacagattaactagttaaggcttgagaagctctgaataattcaaaagtattagacccacacagccttggagagaccttcagaaactaaggaggagttttatattaagggagacattttagtcagtaagacgatataacctacttactccgtaaggggaaatgaaggcccagagaagggaagggacttgaccgaggtcccacttctgtttcgaggcagaagccagactaattttcatgcctcctgactcccaatcagtttcacaaagggattcaatctgtttatatacgttacattcctggatacgaggtcttttgatgttcagagtaactgactagttagtattagaagaccctcgaggtttttttccacagaaaaacatctgaagatggattgggtgagggctggcaaaacgaaggcatgccgggccagctccttaacccaatgacccagtgatgctgcaaggctggaacggggtccaggagactgtgtgtaacaggtgccctaggtgacccttataatcagggaagtttggtgaacaaaaatcgaacccatgagtgaacataaattaaaaagttgatcaacctattaaaatgtgtatttcattgggtagcttttctcactgtagacagattttttccttcttcaatgaaaaggcttttaaattagtacaactgttactatttaaaaaaaaaataccctaagtactctgtttacttctggtgaaacaaaaccagtcattagaaatggtctgtgcttttattttcccagactggagtggcttttctgaaacacacacacacacacacacacacacacacacacacacacacacacacacgtacacacatccctcacttctcttaagccaagaagtttgctttccctagctgcagtgtagatggctcttgtttttgtttttttgttttaatcatttggcattcacatgtggctgttaatatgtgcttgtttttaattaaaacaagaagcttt

SEQ ID NO: 179936 - DNA, 1617 bp, Homo sapiens
  Payload ID: 15452
  Gene Symbol: SEPT6
  Gene Name: septin 6
  Uniprot ID: Q14141
  ENST ID: ENST00000489216
  CDS Start-End: 266-1549
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggttgaaaacgaggcccactgcgactttgtgaagctgcgggagatgctgattcgggtcaacatggaggatctgcgggagcagacccacacccggcactatgagctgtatcgccgctgtaagctggaggagatgggcttcaaggacaccgaccctgacagcaaacccttcagtttacaggagacatatgaggccaaaaggaacgagttcctaggggaactccagaaaaaagaagaggagatgagacagatgttcgtccagcgagtcaaagagaaagaagcggagctcaaagaggcagagaaagagctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgctttttttaatcttgtcttcagcagct

SEQ ID NO: 179937 - DNA, 1393 bp, Homo sapiens
  Payload ID: 15452
  Gene Symbol: SEPT6
  Gene Name: septin 6
  Uniprot ID: Q14141
  ENST ID: ENST00000460411
  CDS Start-End: 266-1069
gaagaactggaactggtctggccatagggggaagcggcgcgttaaatccgccccctctccataccctactttcaaggggtgggcggtagaggggaggttggggttggagcagcggcgagggggcccctcccttgcacctccccccaccggacttggtcgcgcccgaagtgtaacactttctctttgtcggaggagctcctctgtttcctgtgcagtagctcccgttgcggcggcacccgtggcagccctggcggacgcaggagcgatggcagcgaccgatatagctcgccaggtgggtgaaggttgccgaactgtccccctggctggacatgtggggtttgacagcttgcctgaccagctggtgaataagtccgtcagccagggcttctgcttcaacatcctgtgcgtgggagagacaggtttgggcaagtccaccctcatggacaccctgttcaacaccaaattcgaaggggagccagccacccacacacagccgggtgtccagctccagtctaatacctatgacctccaagagagcaacgtgaggctaaagctcacgatcgttagcacagttggctttggggaccagatcaacaaagaggacagctacaagcctatcgtggaattcatcgatgcacaattcgaggcctacctgcaggaagagctaaagatccgaagagtgctacacacctaccatgactcccgaatccatgtctgcttgtatttcattgcccccacgggtcattccctgaagtctctggacctagtgactatgaagaagctggacagtaaggtgaacatcatccccatcattgccaaagcagatgccatttcgaagagtgagctaacaaagttcaaaatcaaaatcaccagcgagcttgtcagcaacggagtccagatctatcagtttcctacagatgatgagtcggtggcagagatcaatggaaccatgaacgcccacctgccgtttgctgtcattggcagcacagaagaactgaagataggcaacaagatgatgagggcgcggcagtatccttggggcactgtgcaggctgcacgagaagtttgaccgtctgaagaaactgcaccaggacgagaagaagaaactggaggataagaagaaatccctggatgatgaagtgaatgctttcaagcaaagaaagacggcggctgagctgctccagtcccagggctcccaggctggaggctcacagactctgaagagagacaaagagaagaaaaattaactctgctgtttgctgcatgctgcatgagacccagggtcctgtaatccatggctgtgtactgaatagtattccccgctacagctggactggactccatttagccttttaagccgagctttttttaatcttgtcttcagcagctgcac

SEQ ID NO: 179938 - DNA, 4350 bp, Homo sapiens
  Payload ID: 15453
  Gene Symbol: SEPT7
  Gene Name: septin 7
  ENST ID: ENST00000350320
  CDS Start-End: 225-1538
gagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatgggtcagcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 179939 - DNA, 4399 bp, Homo sapiens
  Payload ID: 15453
  Gene Symbol: SEPT7
  Gene Name: septin 7
  Uniprot ID: Q16181
  ENST ID: ENST00000399034
  CDS Start-End: 433-1587
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 179940 - DNA, 4066 bp, Homo sapiens
  Payload ID: 15453
  Gene Symbol: SEPT7
  Gene Name: septin 7
  ENST ID: ENST00000399035
  CDS Start-End: 1-1254
atgaaacaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgtaatattgtgtgaggtcttaaatatcctacagtcgatgtacaagagtagagtatgtttgggaagaaacttttcagcttaagtttgcctcctctacaatgacatcttttatatgcttgtctcatttagaatgcatatgtgctgattttctaatttaagagataccatatctctctattcatttctatctctcatttgtatgcttatttttctgagaacattttttttttcccccagacagggtcttgcttcattgcccaggctggagtgcggtggcacaaacacgacttgactgcagcctcaaccctctgggctcaagcagtcctcctgcctcagccccctgagtatctgggattgcaggcgtgcaccaccacgcctggctaatttttgtattttttgcagcctcccaaagttctgggattacaggcatgagccgtcatgcctggcctctgagaacagtttctgactcattcagattaggtatactctcaagtccctggaaactgaaattttttttaactgtaaagagggtagtgtcatttcttttcttaaggtcaagtgacatagattttaatgtaatgcataatttaggtaagaaattaattaatgtagcctagtttattatcttgaaatgttttaccctatttactttttaaaattaatgacctaagcggagggaataattataagtcaatagcagagagattgttgtttgggtgtttatttttttcagtttttgttttgagagattgggttaacacctctagccaaaattgtttggttttagggaggctaacaataacctactgaatttggaaaatgcaaaggtaaaaaatgtatatagactgcctgctgaactggttaagtactactgcttctgggaaatactatttcaaaattctatgtattataataataaatttgtaagacattcattattctaccatcctaatgaaaactttcagaagtctttctttatccatggcatgcccagggttttacctgaatctgatacaggatctatataactttactaggacttttgattgttgactccaggcttaggtatatcagaaggttctttttgccatttggcctgtggatgtctgagaagatcattcacaatacatgtaaaattcaggtaggcctaaggaaaggccagcctgtagaaagcaaaatggcagtgtctgttctccactgttggaggcattatgtaatttaagtatcctgttagccactgtctttctgctaattaagtggggctgaacaagtaagcactaataataccagtgaaccacttgggcaccttgtgggtagagttttgctgccacctagtggaatgggatatcattgcttccatatcaggttcacaagcaagttaagtgggcacagtttatttctgtgtagctcaggctgtaatcttgaaagctgaggagatacccatgcctctcagactcattagctgggtgtcacattaccacctgcacattctgacccaccgcatcttaatatgttttgtcctcttggagaaactaggagtagaagtcaggatatggtaggtaagggggaaaaaggaaagacggcttgatagctatgaatgcatgaggagcgaaatgttgactcagttatctagatcatggtctccaaacctgatgctatttccttacaaaaatatttgttgagcatgtgtccataattatatgtattgaacaatgaaaatatgtgtcaacaaatgtactgctacactaatgtgaacattatggaacaaaatttgaaagagtgaaataaaaggtttacactttc

SEQ ID NO: 179941 - DNA, 1584 bp, Homo sapiens
  Payload ID: 15453
  Gene Symbol: SEPT7
  Gene Name: septin 7
  ENST ID: ENST00000435235
  CDS Start-End: 172-1377
gacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagag

SEQ ID NO: 179942 - DNA, 1362 bp, Homo sapiens
  Payload ID: 15453
  Gene Symbol: SEPT7
  Gene Name: septin 7
  ENST ID: ENST00000432293
  CDS Start-End: 84-350
ggaatgccaacagtttaaaaaacagataatgaaagaaatccaagaacataaaattaaaatatacgaatttccagaaacagatgatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccagttttatccataatgatggatttaacagcatgacaaaaattatttttttttttgttcttgatggagattaagatgccttgaattgtctagggtgttctgtacttagaaagtaagagctctaagtacctttcctacattttctttttttattaaacagatatcttcagtttaatgcaagagaacattttactgttgtacaatcatgttctggtggtttgattgtttacaggatattccaaaataaaaggactctggaagattttcattgaggataaattgccataatatgatgcaaactgtgcttctctatgataattacaatacaaaggttccattcagtgcagcatatacaataatgtaatttagtctaacacagttgaccctattttttgacacttccattgtttaaaaatacacatggaaaaaaaaaaaaccctatatgcttactgtgcacctagagcttttttataacaacgtctttttgtttgtttgttttggattctttaaatatatattattctcatttagtgccctctttagccagaatctcattactgcttcatttttgtaataacatttaatttagatattttccatatattggcactgctaaaatagaatatagcatctttcatatggtaggaaccaacaaggaaactttcctttaactccctttttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtattcatatattgcatttctgtattttttgtttgtattgtaaaaaattcacataataaacgatgttgtgatgt

SEQ ID NO: 179943 - DNA, 506 bp, Homo sapiens
  Payload ID: 15453
  Gene Symbol: SEPT7
  Gene Name: septin 7
  ENST ID: ENST00000635476
  CDS Start-End: 279-506
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattct

SEQ ID NO: 179944 - DNA, 1464 bp, Homo sapiens
  Payload ID: 15453
  Gene Symbol: SEPT7
  Gene Name: septin 7
  ENST ID: ENST00000635175
  CDS Start-End: 1-141
agtgcgagatccgctgctgctgaggagaggagcgtcaacagcagcaccatggttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacagataatgaaagaaatccaagaacataaaattaaaatatacgaatttccagaaacagatgatgaagaagaaaataaacttgttaaaaagataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaactacagaagcagaaaacttgcagctgtgacttataatggagttgataacaacaagaataaagggcagctgactaagagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgtattttagaacaacagaactcttcaagaaccttggaaaagaacaagaagaaagggaagatcttttaaactctctattgaccaccagttaacgtattagttgccaatatgccagcttggacatcagtgtttgttggatccgtttgaccaatttgcaccag

SEQ ID NO: 179945 - DNA, 509 bp, Homo sapiens
  Payload ID: 15453
  Gene Symbol: SEPT7
  Gene Name: septin 7
  ENST ID: ENST00000635172
  CDS Start-End: 279-509
aagtcatgctcgaaatggagcgaggcggcggagctggggaggcggtaatctcgcgagatggaagccagcctccgctaggcccggaagcctcgtctgagggggcgggggacggaggagggagcgggagtcgagcgagagcctgtggaggagtccgcctgctgtagcgtgcgtaagcaaggcagctacgccgggcggctacgctgcggaatcggcgtaggcgcctttggagaatcggcgggctgcgctccgctggggctggtcgcggagggggggaggggatgtcggtcagtgcgagatccgctgctgctgaggagaggagcgtcaacagcagcaccatggtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattct

SEQ ID NO: 179946 - DNA, 760 bp, Homo sapiens
  Payload ID: 15453
  Gene Symbol: SEPT7
  Gene Name: septin 7
  ENST ID: ENST00000635047
  CDS Start-End: 290-760
agtgcgagatccgctgctgctgaggagaggagcgtcaacagcagcaccatggtgtttcaatggatttgcctctcctgtttggactgaatatgtcattacaattcttggaattctttgtttactgttcctctgtggatttcttctgttggaatctggaacactggaatgatggaaatgtgttctttacaaagtagctcaacagaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcacaccagaggaatgccaacagtttaaaaaacag

SEQ ID NO: 179947 - DNA, 583 bp, Homo sapiens
  Payload ID: 15453
  Gene Symbol: SEPT7
  Gene Name: septin 7
  ENST ID: ENST00000634600
  CDS Start-End: 143-583
gtcagtgcgagatccgctgctgctgaggagaggagcgtcaacagcagcaccatggaagaaccttgaaggctatgtgggatttgccaatctcccaaatcaagtatacagaaaatcggtgaagagaggttttgaattcacgcttatggtagtgggtgaatctggattgggaaagtcgacattaatcaactcattattcctcacagatttgtattctccagagtatccaggtccttctcatagaattaaaaagactgtacaggtggaacaatccaaagttttaatcaaagaaggtggtgttcagttgctgctcacaatagttgataccccaggatttggagatgcagtggataatagtaattgctggcagcctgttatcgactacattgatagtaaatttgaggactacctaaatgcagaatcacgagtgaacagacgtcagatgcctgataacagggtgcagtgttgtttatacttcattgctccttcaggacatggacttaaaccattggatattgagtttatgaagcgtttgcatgaaaaagtgaatatcatcccacttattgccaaagcagacacactcaca

SEQ ID NO: 179948 - DNA, 333 bp, Homo sapiens
  Payload ID: 15453
  Gene Symbol: SEPT7
  Gene Name: septin 7
  ENST ID: ENST00000485569
  CDS Start-End: 1-333
gtgacttataatggagttgataacaacaagaataaagggcagctgactaaacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgagctccagcggcgccatgagcaaatgaaaaagaatttggaagcacagcacaaagaattggaggaaaaacgtcgtcagttcgaggatgagaaagcaaactgggaagctcaacaacgt

SEQ ID NO: 179949 - DNA, 4394 bp, Homo sapiens
  Payload ID: 15454
  Gene Symbol: SEPT8
  Gene Name: septin 8
  Uniprot ID: Q92599
  ENST ID: ENST00000296873
  CDS Start-End: 285-1574
gcagctggcacctcccgcctcgccgcggagacccccggccgtccaagcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttgagtt

SEQ ID NO: 179950 - DNA, 562 bp, Homo sapiens
  Payload ID: 15454
  Gene Symbol: SEPT8
  Gene Name: septin 8
  ENST ID: ENST00000371493
  CDS Start-End: 327-562
tttttcaggctgctgcttctctgattgctcagactattgcttggttgctaagtagggagccacagacctggtccacggagacttggaaagctgtgtcctggcttcatgaatctccagcagttggtgccctttgctacccatctttaatcatccctttcagtcccttgccttctcagaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccg

SEQ ID NO: 179951 - DNA, 2289 bp, Homo sapiens
  Payload ID: 15454
  Gene Symbol: SEPT8
  Gene Name: septin 8
  Uniprot ID: Q92599
  ENST ID: ENST00000378699
  CDS Start-End: 502-1611
acattcccagaaagagcagagagaaaggcagagggaagagaaagaaacggggtttcagaggatttgggagctgcttttgtatagattgtcagtgagaaggatacagaacctcctgaggcctccgaccctggcgaatcccagcctaaactgcgcatcctgctcgttggttgcacaaggagccgaaggctggtcccttgcccgggaaggccgcctggccggacgcgcgggtcccgccggggttcccgccttagctccggccggagcatcaggtggggcccaagacacccgcagactaggctgccgcggcctctcccggatccgacgggtctcccgcagcttgtccacactctgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgaca

SEQ ID NO: 179952 - DNA, 1817 bp, Homo sapiens
  Payload ID: 15454
  Gene Symbol: SEPT8
  Gene Name: septin 8
  ENST ID: ENST00000378701
  CDS Start-End: 125-1447
aggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgac

SEQ ID NO: 179953 - DNA, 4168 bp, Homo sapiens
  Payload ID: 15454
  Gene Symbol: SEPT8
  Gene Name: septin 8
  ENST ID: ENST00000378706
  CDS Start-End: 208-1500
gccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaatcttgacccttagcctgggacaccacaaactgaggtgaattctctgctttgctcgtcacaaatgccaaactgactgccctttcacggtgtccatcttgctgtcttttgcttctgtttgatttggtctgcatatcttttaatgtgtctgtttttgttttgtttgttttatttttatttttcagttaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaat

SEQ ID NO: 179954 - DNA, 2889 bp, Homo sapiens
  Payload ID: 15454
  Gene Symbol: SEPT8
  Gene Name: septin 8
  Uniprot ID: Q92599
  ENST ID: ENST00000378719
  CDS Start-End: 239-1690
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaacagatcagatataggagcacaccagccgggcatgagcctctccagctctaaggtgatgatgaccaaggccagtgtggagcccttgaactgcagcagctggtggcccgccatacagtgctgcagctgcctggtcagggatgcgacgtggagggaaggattcctctgaggcagcagctccaacacatggggccagctcaggaccaccagggcatggaactggagaccatggtttttaatgttagaacagaaaacgccatacttttcctatatcaatgatcaaaagtgcaaacaatttaaatttccatcagggaacatcaaatgttgcccaacccttttcattcctatccatggctccgtaaggggcttgaggcttaatgcccatcctgtggccaagctgagcttccactccgggaccaaaaaaaaaaaaaagtctgctttgtgacatcatcgttatgagcggaaagtacctagatgacaatgtttccattctgaaaaatagaaacatactattcaagaccaaggtagcagaaaagttacttgtatctgcttatcataagacgaaactctgcaacttggcaacggtggccagttttcgtaatgaaacagtctttagtaatttaatcttcatgcttcataacaaaccaaaaccccatgagatttccacattgcataattttgccttactaacagaatcatatccttaaggatgaccatcattcccccaactaaaacaaatacaaactaatgtatgatatttttttaagtgccagatcaatatggtctaaagcttcaataaggattgtgtgtaggtgaataaagacagctaagtgaatgtgtgtaaagtgtagcaaaagcagacagatatttatgtacagtattcatagaatggaaagttaaatatttttgcagtgtgtatttaaaagagaaactcaccataatagtgccgtctaaaaatctttgtaaagttaatttaatgtcctttagaagtgggagtctggtggaactgtgttggatttaagataccttttcactcttccgtatgtcatgagccttgtgcgtcacctcactgtggtgcatgtgcaagggcgtgtgcacgcctgtgctttgccatcccatgttgtaaacagctgttccaaaggcacaaacgagtttagggtagactctgtaaacacctccttactcactatagtcaagaagtccagcggcgtcccaatatagaggtcccagtgcagtctgtccagaatagccagctccatcctcagcagctcattcggggaatagtcagagccatagtgctttgtgaagtcttttacttgtggaataaactgtaaaaagaaaataaagaggccaaagccctacatcatg

SEQ ID NO: 179955 - DNA, 1723 bp, Homo sapiens
  Payload ID: 15454
  Gene Symbol: SEPT8
  Gene Name: septin 8
  ENST ID: ENST00000378721
  CDS Start-End: 102-1484
ttcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaaggtttgagttggatcagctctcagaatccagctcacatccatagccacctggttaagcagcagatgtcttccagcagttcccctaaagcctgggatgcctaaactggtatgggccctcaggatgtccttctgcctcatgcactgtggtcccacttacactggaaggaaggaggcagagggcactcaacggccaccactggaagctgtgagcagcatggcctcagcatctccatctgtaaaatgggttctggactagaggagagttcttgatatgacctaggagatagtgttccaaatgtatctgactctcgcaaggctaaatgcatggtagctcaaaataa

SEQ ID NO: 179956 - DNA, 1726 bp, Homo sapiens
  Payload ID: 15454
  Gene Symbol: SEPT8
  Gene Name: septin 8
  Uniprot ID: Q92599
  ENST ID: ENST00000458488
  CDS Start-End: 84-1412
ggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaaagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgt

SEQ ID NO: 179957 - DNA, 4270 bp, Homo sapiens
  Payload ID: 15454
  Gene Symbol: SEPT8
  Gene Name: septin 8
  Uniprot ID: Q92599
  ENST ID: ENST00000448933
  CDS Start-End: 345-1454
tgctcgttggttgcacaaggagccgaaggctggtcccttgcccgggaaggccgcctggccggacgcgcgggtcccgccggggttcccgccttagctccggccggagcatcaggtggggcccaagacacccgcagactaggctgccgcggcctctcccggatccgacgggtctcccgcagcttgtccacactctgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttg

SEQ ID NO: 179958 - DNA, 773 bp, Homo sapiens
  Payload ID: 15454
  Gene Symbol: SEPT8
  Gene Name: septin 8
  ENST ID: ENST00000453480
  CDS Start-End: 383-773
gactaaagcaggagctcttggtttcataatttctagactcgggtgttttattcccattggagagggggtcgtatgtcagttaagtaagtttaaatacatgaggaacagattcagaggctgggctactcagagattcacttcgccccgtattataaattggaatttatgtaccggaggagggcagtgcctgaatcctaacagacctgctgattagctggaggccaagagacccaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctcca

SEQ ID NO: 179959 - DNA, 693 bp, Homo sapiens
  Payload ID: 15454
  Gene Symbol: SEPT8
  Gene Name: septin 8
  ENST ID: ENST00000414594
  CDS Start-End: 403-693
ctctttgcacaatggtggaaccattaagacgttgtcccaagcccttgggacaggcagggtgatggacacttgcaatctgacgccttgaccgtcgagctccgcttttctattgcaggaatcccagcctaaactgcgcatcctgctcgttggttgcacaaggagccgaaggctggtcccttgcccgggaaggccgcctggccggacgcgcgggtcccgccggggttcccgccttagctccggccggagcatcagaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgggctttggggatcagatcaataaggatgagagttacaggcccatagttgactacatcgatgcgcagtttgaaaattatctgcaggaggagctgaagatccgccgctcgctcttcgactaccatgacacaaggatccacgtttgcctctacttcatc

SEQ ID NO: 179960 - DNA, 4335 bp, Homo sapiens
  Payload ID: 15454
  Gene Symbol: SEPT8
  Gene Name: septin 8
  ENST ID: ENST00000620483
  CDS Start-End: 239-1519
gcggcggggctccggctgcgctcgtggccgggccgggcggggaggccggtcccgcgggcgggggcaggggcggctccgcggcttctcccgccgccgccgccaaggggagtttccaggaagtggccatattggatccattcagccgcagccgcccgggcggagcgcgtcccgcagccggctggtccctgtcgctgcccctgcgctcgtcccagcccacccgcccggtgcggagctcgccatggcggccaccgacctggagcgcttctcgaatgcagagccagagccccggagcctctccctgggcggccatgtgggtttcgacagcctccccgaccagctggtcagcaagtcggtcactcagggcttcagcttcaacatcctctgtgtgggggagaccggcattggcaaatccacactgatgaacacactcttcaacacgaccttcgagactgaggaagccagtcaccatgaggcatgcgtgcgcctgcggccccagacctatgacctccaggagagcaacgtgcagctcaagctgaccattgtggatgccgtgtctggagaaggggtcagctgcctttacaggcccatagttgactacatcgatgcgcagtttgaaaattatctgcaggaggagctgaagatccgccgctcgctcttcgactaccatgacacaaggatccacgtttgcctctacttcatcacgcccacagggcactccctgaagtctctagatctagtgaccatgaagaaactagacagcaaggtgaacattattcccatcatcgccaaggctgacaccatctccaagagcgagctccacaagttcaagatcaagatcatgggcgagttggtcagcaacggggtccagatctaccagttccccacggatgatgaggctgttgcagagattaacgcagtcatgaatgcacatctgccctttgccgtggtgggcagcaccgaggaggtgaaggtggggaacaagctggtccgagcacggcagtacccctggggagtggtgcaggtggagaatgagaatcactgcgacttcgtgaagctgcgggagatgttgatccgggtgaacatggaagacctccgcgagcagacccacagccggcactacgagctctaccggcgctgcaagttggaggagatgggctttcaggacagcgatggtgacagccagcccttcagcctacaagagacatacgaggccaagaggaaggagttcctaagtgagctgcagaggaaggaggaagagatgaggcagatgtttgtcaacaaagtgaaggagacagagctggagctgaaggagaaggaaagggagctccatgagaagtttgagcacctgaagcgggtccaccaggaggagaagcgcaaggtggaggaaaagcgccgggaactggaggaggagaccaacgccttcaatcgccggaaggctgcggtggaggccctgcagtcgcaggccttgcacgccacctcgcagcagcccctgaggaaggacaaggacaagaagaattaacgcacgcacagacttacatgtcaagagtggactttagactttcatgtgttaagttgcttgagttacaccttgtgacccttctcccataacatggtgtgaggacggactgggagccggtacagactccagtgtttacagccttgctttcctcccaccgaccctggccccaggctgccccgggcctggcgggccacccctctctatgcaaacacgtaaaagccatgaatgctggaatccaaaactgacgaggtttatttttttcagagccagtggctggtcttccatttacagtgtcactattccctgacggagctgttatgtgccgctctagcgaaggccccagccgggatgctaggcctaattgttcagcgtggagatggcaactcacgtggtgccctaggtgcagctgcgtggtctggtatacatgctgcaaaattcacccagttcccctcattttaatttttctaacctacagcttaattttaataactttaaaacacttctaaatatttattttggcaccagcgtcaagacaaataatatcctctcccattattttcataagtaacacagattccctgatttttaaaaactaaaaatacagctaaacctttcttatgtataaagtatgcctatcatatacagggagaggtgggtaataaacttcctgtaatgacagtgtttggcatttctttatggatggaattggaacatgaacaagaccatgtccagcgtttttactgtgaatgtaaatggaacagcagcccaaagctgttgtctgtgccccagaggtgctacctgtagacagggaccaactccatgtgtgtgtgttaagtgtttgactccaattaagactcccaagcaaatcctgcatattccaaatgtaaagagtactcagtgggaaaaaggttgttacctcaaagtcattgcttctttcctggctgggtcacagggtgaagagatgaaggtgtctgatgtatatagacaattagggaaaaatgagcggcaaaggagctttccccttcagctgcactctaaaggggaacattttaaggaagtactagcagctttgactcttctatgctcctgttggtttacaagccaccaagaatgtcagtgttgagaatacggcctggtaaaatgggagatgtaaaatgactaaatgaaaggaagggtagttttaatgttgaagcaccgtgctgggcactggagctacccagaggaatgcacaacgctcccctcaaggagctcacagtctagcctactccctggctggaagcctcaggaagacgtgctaatttattgtggaattggtagtttgcttttcatgcccctgtcttccttctcatgaccatttccccctttctgtctggcttgcattattgatttccaggaccaagtcctggcttcctcctgccttcctgagatgatgttctgctcagggagaagtggaggggtgagctgtgtgtgtccaccgaggcacggccaggaagaggcagcctttacctgtgaggggctccatgctccagcagcagagcaggttctagtgacaattcaactttttatgctatgaccaggggtggatctaaattttatggggctgaaagcttgaattatttagaaagacttctttaagaaaaacaatgttaatataaaattaggtacagggtcttggaaggggccctgaagattaagcttccttagcgtcacaataagtccgtatctggttgcaattgaaaactgatgcttcagtgagggtatctaaaaaggtaaactggcatatccagggcaaatgtgggctgccaatggctcatctctagggtaattttatgtctgaaagtgtatgcagttgggtcagagcatgacctttaagatagcctctctcagctaacatatttatgaagatgaggcctggtgacccagcaggttcattggatacataagaaatgagaattcctggttcatgggccaacctaggactctggagtatgcagacttggccattcgtccattgtggcctgcgggtcgcaccccaggcatactgaaaggccatactcgtggctggctgcctgcgggcctaagccttcccaggatcttcaggacacttgacagacttgtgttttctggtctgagctgcctccacaggtccctccagcaagcctcactgcacctctcccctgctgtttgtgtttggaattttgtcttctttagctgagaccaaattaaaccttggtgcataaagtgagcttaaaacttgccactgtttagtaagttagcccccatagaatgtgaccctgtctgcagagtctcatttacccctctttttctcattgtcatttgttggctttattagggctgtcttacaggatcatgttggcatttactatcatgtctttatcataaaccatgtttgtttgaggtagaagaatcaccatataattcgttgcccaaattgggactattgagagagaaaggggatgctattaattacaccagatcaaaaggcataaaccagacctgtcccaggccgatgtggaaatatgttctttctagttgtgggtaccctgatctaggtggtttgtaattgtgcattactgactgcatatgtttgtgtatgtgtaaatgtgggctccctgttaagtggggctcatggatacgaggcctgaggaagtgtggcttgctagtctgttacgttaacatgcttttctaaaattgcttcacgtgttaattcatttactcctgcattcattgactgtttttgttcttttccattcactttgtacttatttttttcattaaattttgcatttattttg

SEQ ID NO: 179961 - DNA, 4453 bp, Homo sapiens
  Payload ID: 15455
  Gene Symbol: SEPT9
  Gene Name: septin 9
  Uniprot ID: Q9UHD8
  ENST ID: ENST00000329047
  CDS Start-End: 813-2519
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 179962 - DNA, 3821 bp, Homo sapiens
  Payload ID: 15455
  Gene Symbol: SEPT9
  Gene Name: septin 9
  Uniprot ID: Q9UHD8
  ENST ID: ENST00000427177
  CDS Start-End: 127-1887
actccagacggcgggccgccccctcttcccgccttcctactaccggcccaggattagcgccctgggagcgcgcgccccgctgcctcgccgccacactttcctgggagcggcggccacggaggcaccatgaagaagtcttactcaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 179963 - DNA, 3996 bp, Homo sapiens
  Payload ID: 15455
  Gene Symbol: SEPT9
  Gene Name: septin 9
  Uniprot ID: Q9UHD8
  ENST ID: ENST00000449803
  CDS Start-End: 794-2062
actgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 179964 - DNA, 3937 bp, Homo sapiens
  Payload ID: 15455
  Gene Symbol: SEPT9
  Gene Name: septin 9
  Uniprot ID: Q9UHD8
  ENST ID: ENST00000427674
  CDS Start-End: 733-2001
gtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgcggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 179965 - DNA, 3984 bp, Homo sapiens
  Payload ID: 15455
  Gene Symbol: SEPT9
  Gene Name: septin 9
  Uniprot ID: Q9UHD8
  ENST ID: ENST00000423034
  CDS Start-End: 309-2048
ccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 179966 - DNA, 4004 bp, Homo sapiens
  Payload ID: 15455
  Gene Symbol: SEPT9
  Gene Name: septin 9
  Uniprot ID: Q9UHD8
  ENST ID: ENST00000431235
  CDS Start-End: 798-2066
actgggcggcccttagacccaggctgcctgctgtctctggcaggaactcaagtcgctggtcatcctcagagcggtgttggcccggggccttcagtggcctttgtgtctgggtgagaggaaccctggatggccactctgccctgagtgtgtgggtccccagaagtgctgggttagggggcacggagggccagaaagtcccctttggagcgctggactctctcgctgactcctaccccaccccggcctggggtttcagagaaggggtccaggcaggagtgtcatcttttctcaatggggatgtggcttcagtctctgtccaggtgggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 179967 - DNA, 3635 bp, Homo sapiens
  Payload ID: 15455
  Gene Symbol: SEPT9
  Gene Name: septin 9
  Uniprot ID: Q9UHD8
  ENST ID: ENST00000427180
  CDS Start-End: 277-1701
agttaccatcgtggggagactgtctggacgcagagagcaggctctgtgtgggagcggggagggcaagccctggttgcgaggcagggcttccccaggattcagcagggatctgaaggactttgcaggcacccagggagataggagaggaggagggagcagccctggccggacactgtcctcctagcattgcctgcatcagggactcactcagctttaagaagcccctttgtgggggacagggagcatctgttagtttataggacctgaagtgcccccatgggctcaagtttctgggaaggcctgcaggtggccgtagggctgccgcaggggtgctggccccagggtctggattcaggggagcctgcagagggagggcagctggaggctgctccagtgtgcattgttacgaggcaaagtaaggagactgctgggcccacgctgggccggggtggatggaggcaaggaagtcttcgccggggcaagggcaccagctgtagatgccggcagctttctcctggacacgggcctggaaggctgacagggtgtggtgagtgccaccggctcccctgccgtggcctggtcagtggcttcacaggcctccgtgggcaggaggaggatgaccttgcattctgcttggccaccattggcagtgacagacaagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccc

SEQ ID NO: 179968 - DNA, 3026 bp, Homo sapiens
  Payload ID: 15455
  Gene Symbol: SEPT9
  Gene Name: septin 9
  Uniprot ID: Q9UHD8
  ENST ID: ENST00000541152
  CDS Start-End: 83-1090
aggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaagtgagtctggtggaggagctgagggagggagccatggaaggtgccagaaggaaggttggcgggggcacgtgtgggccgtggcttgggctggtcagagtggcgtgagctgcccggcgcctgccctgcccaagtgaccagggaagtgtgtgtgtgtccatgtgtatgcgtgtccgtctgtctgtctagtgtctgggtttggcccaagactgggctgtagttacattaatgcccagccagccacccctgccactcacccttcctggcccaggccttgctgactctctgagctggggaggtgggaggccaggcgagcctgactctgttgatctacccgtgcctgggcccctcccctcagagcccatggtaacgaacccctagaaaggagagaacgggcgtcaggggtgcacagtccacagctgaagagcaaggtttcgtggcagcacggcccggcccctcaccctctgtccccacgaggggacccatgggggctgtctttgcagggcacagatgaccaaagtcccttcctgcttcctgttacctgtcttgctcctggggagaaagaggggcctgatgagactccactcaggtgcacacatcaccaggtgcatctgcaggcaccgggctggctgcttgcagccaggagaaggtcagcgagaaggagtgtatgagtgtgagtgtgtgtgcatggaagttggggcactgggcgtctgactccctccccacccaagagaggaaggacccctcaccacccccactggtgagacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccag

SEQ ID NO: 179969 - DNA, 879 bp, Homo sapiens
  Payload ID: 15455
  Gene Symbol: SEPT9
  Gene Name: septin 9
  ENST ID: ENST00000588958
  CDS Start-End: 253-879
ggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcgg

SEQ ID NO: 179970 - DNA, 569 bp, Homo sapiens
  Payload ID: 15455
  Gene Symbol: SEPT9
  Gene Name: septin 9
  ENST ID: ENST00000590595
  CDS Start-End: 167-569
acgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagg

SEQ ID NO: 179971 - DNA, 582 bp, Homo sapiens
  Payload ID: 15455
  Gene Symbol: SEPT9
  Gene Name: septin 9
  ENST ID: ENST00000589070
  CDS Start-End: 208-582
aattagtcacttcttcctctgtacgttggaaacaccgctttatcgtggagactttaaggatatccaagtagagagaattcttccgtgcaagttttgcatcctctcaccactgcctgcgttacccgagttgtaaagggcggctccctgtgtctgccccgctgcaccgatacaccgagctgcgcacggtgcccagcgcagggagaacaaatgatcatctgtccaacgcgcccatttacagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccac

SEQ ID NO: 179972 - DNA, 749 bp, Homo sapiens
  Payload ID: 15455
  Gene Symbol: SEPT9
  Gene Name: septin 9
  ENST ID: ENST00000591704
  CDS Start-End: 164-749
gccagcaagcacctggggtagaggggacaaacccaggtggctgtgttccagccctggctgcaggtctgaatggctttctggggtggctggccatgctccctgagagcccagctgtggcgatgtctgagcagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcgg

SEQ ID NO: 179973 - DNA, 2816 bp, Homo sapiens
  Payload ID: 15455
  Gene Symbol: SEPT9
  Gene Name: septin 9
  Uniprot ID: Q9UHD8
  ENST ID: ENST00000590294
  CDS Start-End: 813-2519
tgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatccatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccagaa

SEQ ID NO: 179974 - DNA, 583 bp, Homo sapiens
  Payload ID: 15455
  Gene Symbol: SEPT9
  Gene Name: septin 9
  ENST ID: ENST00000590576
  CDS Start-End: 45-116
agatctccccggcctgcccagagggattctgatagccgagggcaatgcacctggcagcggagcattgcgtttgcgacagtccaccttcttcctggaaccaccccccacaagtgtgaccagctcaagccaggacaggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaa

SEQ ID NO: 179975 - DNA, 817 bp, Homo sapiens
  Payload ID: 15455
  Gene Symbol: SEPT9
  Gene Name: septin 9
  ENST ID: ENST00000593189
  CDS Start-End: 191-817
tggaagggcctgggaggggacaggctcccaccccaggagcttccaggttccggctgctgcctgtgttagctgcgtgagcgtgagcgagccaggggtcactactgggtggaaggaagaagcgggcatttcttccaggaggtcaccgttggagtcccacaccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcgg

SEQ ID NO: 179976 - DNA, 565 bp, Homo sapiens
  Payload ID: 15455
  Gene Symbol: SEPT9
  Gene Name: septin 9
  ENST ID: ENST00000585638
  CDS Start-End: 133-565
gagctttgctggggaggcagcgtggctgcaggatggcagctttttagaggacaccacggccagggacatccacccgggggaattctcaggggtcgcctggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtca

SEQ ID NO: 179977 - DNA, 670 bp, Homo sapiens
  Payload ID: 15455
  Gene Symbol: SEPT9
  Gene Name: septin 9
  ENST ID: ENST00000590059
  CDS Start-End: 193-670
attcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccatcatgtcggaccccgcggtcaacgcgcagctggatgggatcatttcggacttcgaagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatca

SEQ ID NO: 179978 - DNA, 601 bp, Homo sapiens
  Payload ID: 15455
  Gene Symbol: SEPT9
  Gene Name: septin 9
  ENST ID: ENST00000586521
  CDS Start-End: 279-601
agaatgtggcgatttgtctgtatgcagacattagattagagggcaaaggccattatcataacttagcagacagctacaagcagctaaggaattgctatgacatggactgctcgtgattggagctaagaaggagtcagagacagaggtccctgtgctctggcgtgagtccttgggggaggctgagctcccagaatgtggggccgcctgtgcagaggccggaggtgggagacacacctgtgagtgccgccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgac

SEQ ID NO: 179979 - DNA, 611 bp, Homo sapiens
  Payload ID: 15455
  Gene Symbol: SEPT9
  Gene Name: septin 9
  ENST ID: ENST00000590938
  CDS Start-End: 205-611
aatgcgaggcacttccacaggaggggacaaccccgtccttaggagccccttctccctgcccccaggcctggtgcagtgtgtggcttccctgccggtgtcaaaggtctcaaggcccctttaagaagcctgtcaccaccaccagcagcttccgttatctggttcttctgtacatccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagta

SEQ ID NO: 179980 - DNA, 1691 bp, Homo sapiens
  Payload ID: 15455
  Gene Symbol: SEPT9
  Gene Name: septin 9
  Uniprot ID: Q9UHD8
  ENST ID: ENST00000591088
  CDS Start-End: 318-1325
gtgccttcaggttgcttctgcgccgggcctgccgctgggcgcccctatctctgcctgccccctcctcctgctcccctcgccctgcccccttggagcaattccccaccgagcctcccttcccaggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggcca

SEQ ID NO: 179981 - DNA, 580 bp, Homo sapiens
  Payload ID: 15455
  Gene Symbol: SEPT9
  Gene Name: septin 9
  ENST ID: ENST00000589920
  CDS Start-End: 267-580
atggagctttgctggggaggcagcgtggctgcaggatggcagctttttagaggacaccacggccagggacatccacccgggggaattctcaggggtcgcctgggcaagtcgcttagcctttctgagcctcagtgcctcagtttccccatccaaggatgggtgtgacaaccacctggcaggcgcctgtgtgtgagcccctgttccgctctaactcctctgctgttccttccccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggat

SEQ ID NO: 179982 - DNA, 1793 bp, Homo sapiens
  Payload ID: 15455
  Gene Symbol: SEPT9
  Gene Name: septin 9
  Uniprot ID: Q9UHD8
  ENST ID: ENST00000592951
  CDS Start-End: 404-1411
acatgtaagcctttcccatacaccccggatgtttagggcttccgccctctctccctggccgggagtgtgggaagagggctttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcag

SEQ ID NO: 179983 - DNA, 576 bp, Homo sapiens
  Payload ID: 15455
  Gene Symbol: SEPT9
  Gene Name: septin 9
  ENST ID: ENST00000591833
  CDS Start-End: 100-234
cccgccttcctactaccggcccaggattagcgccctgggagcgcgcgccccgctgcctcgccgccacactttcctgggagcggcggccacggaggcaccatgaagaagtcttactcagatttgcttctggacccgtgcatttcaaatcttgcttctctccactgcgcacgtttttccggcgccaggcaccgcaggatatgttcgtgtcttgtgatttttgattctgcgcggtaggtggaattggaacggaggcacgcggacctccagtggccggctccggaggcttggtgactccagtggcccagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtc

SEQ ID NO: 179984 - DNA, 552 bp, Homo sapiens
  Payload ID: 15455
  Gene Symbol: SEPT9
  Gene Name: septin 9
  ENST ID: ENST00000589140
  CDS Start-End: 97-552
cgtttagactgggccagcagacagttctagagacttcaagtttgttgtcgtttttaaaagtcctgccaatgcccagaaacttagagggacaagaagatgacctcgatgtcagccgggaccataaacaccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccc

SEQ ID NO: 179985 - DNA, 2588 bp, Homo sapiens
  Payload ID: 15455
  Gene Symbol: SEPT9
  Gene Name: septin 9
  ENST ID: ENST00000592420
  CDS Start-End: 456-1025
actccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcggtgagtcctcaccttgcatgccactcaaccaatgccggaaaccagcctcagcccccagggcggcccacaagcctttgggcttggtcttcccttctgtaaaatggggcagcaaccctgacctcaaggacggattgccagtgacattgcgtgtgcatgcatgcgcctgggaggagcccacagcctccagcggctcctcagaggggcctgtcctgcacatccagggcccctgagatgactttggggagcccaggccggcctggagcaggtcctgatgagtggtcgctgcctctgagcaatgacgtcagcttgtgcagagggttctgtggcagctgtcccctcactgttgctccagcctggccctccaggctccccaccgcaccccaccgcaccccggccagaggcttcccagcagctcagcttcagctctgccctggaattggggcctcgtggcttccacaccccctggtggccccggagagctggaggtcaccacgggaggtcgtcgatcagcacgacctgggcagggtgagggggccaggctggagtctacagtgggccgcctgttgtttccaaagccccccaggtcccattcaaacctcacagggaccctgtgaagggggcgtcccgttttccaggcagaagcgaggctcagggaaggctgccaaggttccttagctcacagggcagagaaccgcagccaccgttttgactcccagaactgtgttctgcccactccacggggtccagggaggggtctggggaagtgcccccgccaggtcacaccctaaacaaaggtgagcttgcggggtttctgcaaggtgtctgggcacctctcaggccgggcctgtttctctgacctttgccagccgtgcacgtccttcctgcccagctctgtggacgcaaacccacacctgccagcccgacacctttctttcctcttctgcactgatctgggccctggctcccctggggtcttggtgtcctctctgcttcctgtagcctcatgggacccggctgctcatggccctgctgtgctcacagctgcctggaagctggcagcctgcttcaagggagggcggaggtgtggggtcccctcctacggcccccaccctgttctgcctgttgtgggggacgtgcttgtaccctgaggattcagggctgcctcccgggaagatggctggagagaaagagaggggagaggcccaaaggcagtggccaggctgggactcatctctgtgggctacggaggggctgccctgctccctagccagggacagggtgagaaggacctgggaacctctgcgtcccagccatggcacaggccttcttccggagctttggccccaaggagagggagaggcagcccagcagccctcgccttccgtggctgccactgtgacagccttgccctctgggaatggtgcgcaggaggccacttcacctgtctgggcctcttcgccctttcaaccctgagaagaacagtggtcctgattccccacaaaatcactccctcccagggatgccgagtgaggaacaagacgtggggcagctctgctctcctccctcctccctcccatggcagctgtgcccacctgcagaggtgcaggcaaggtggaggggcacctgtttggaggtccacagaccccggggagaatcccagctttgtcctaactcagcggggtgaggcttgtgtgtcttcccctgggctcctcctctgtgagccttagcttcctcgtccataaaatgggatcatcccataaagtgagatcaagcgagctaggccccgggcaggg

SEQ ID NO: 179986 - DNA, 541 bp, Homo sapiens
  Payload ID: 15455
  Gene Symbol: SEPT9
  Gene Name: septin 9
  ENST ID: ENST00000590917
  CDS Start-End: 317-490
aatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgagcggcttgggtaaatccaccttaatcaacaccctcttcaaatccaaaatcagccggaagtcggt

SEQ ID NO: 179987 - DNA, 906 bp, Homo sapiens
  Payload ID: 15455
  Gene Symbol: SEPT9
  Gene Name: septin 9
  ENST ID: ENST00000585929
  CDS Start-End: 411-906
tttatttcaatgcttgagagtagggtcaatggccagggtaagctgtgggggctcctccccgccggcccctctctgcagccctcaccttaacacagagcatcgataccacctgggctttgggaagacctggaggctgaccaccctggaggctcccagcgtcccacagccactctttggggaagaggcttcctgagggacttgtggcccttggctgggactctagtcccagagttctgccttccggcgccgagctttgatttgtttattgagtgccagcccggttcccggacaggtagggacctgttcccggagctcagcagagccttgggaagctttcccaggagggctcccgagggtggcggccatgcccagtccgctccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccg

SEQ ID NO: 179988 - DNA, 752 bp, Homo sapiens
  Payload ID: 15455
  Gene Symbol: SEPT9
  Gene Name: septin 9
  ENST ID: ENST00000586128
  CDS Start-End: 406-752
cagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcagggcagtcgaggtccctccctacctctgccccgcgctctgggaggctccttgttccgcgaccacaaagcccctttgatcctctgctcggctctgagccatgtgacccggtgggcgggccgcggctctcggcgcgtccagcgcagcccgacgttccgctgctgggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcgg

SEQ ID NO: 179989 - DNA, 582 bp, Homo sapiens
  Payload ID: 15455
  Gene Symbol: SEPT9
  Gene Name: septin 9
  ENST ID: ENST00000591020
  CDS Start-End: 112-582
gcaaggccccacgcagcctccgactcacccactgcccgtgtgtatttcaggaggctgcatcccccaaggcccccaccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtc

SEQ ID NO: 179990 - DNA, 559 bp, Homo sapiens
  Payload ID: 15455
  Gene Symbol: SEPT9
  Gene Name: septin 9
  ENST ID: ENST00000588575
  CDS Start-End: 177-449
ttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagt

SEQ ID NO: 179991 - DNA, 569 bp, Homo sapiens
  Payload ID: 15455
  Gene Symbol: SEPT9
  Gene Name: septin 9
  ENST ID: ENST00000586433
  CDS Start-End: 115-569
agggcttccgccctctctccctggccgggagtgtgggaagagggctttatttcaatgcttgagagtagggtcaatggccaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcat

SEQ ID NO: 179992 - DNA, 1387 bp, Homo sapiens
  Payload ID: 15455
  Gene Symbol: SEPT9
  Gene Name: septin 9
  Uniprot ID: Q9UHD8
  ENST ID: ENST00000585930
  CDS Start-End: 16-1104
atctaaatctcggtgatggctggtgctggatgcacagggacgtggtcctggctctgggggacagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctcccc

SEQ ID NO: 179993 - DNA, 554 bp, Homo sapiens
  Payload ID: 15455
  Gene Symbol: SEPT9
  Gene Name: septin 9
  ENST ID: ENST00000590825
  CDS Start-End: 450-554
agtgcctgagtgcatttggaggaagagagacggccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgccc

SEQ ID NO: 179994 - DNA, 2160 bp, Homo sapiens
  Payload ID: 15455
  Gene Symbol: SEPT9
  Gene Name: septin 9
  Uniprot ID: Q9UHD8
  ENST ID: ENST00000591198
  CDS Start-End: 86-1789
accggcccaggattagcgccctgggagcgcgcgccccgctgcctcgccgccacactttcctgggagcggcggccacggaggcaccatgaagaagtcttactcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcct

SEQ ID NO: 179995 - DNA, 555 bp, Homo sapiens
  Payload ID: 15455
  Gene Symbol: SEPT9
  Gene Name: septin 9
  ENST ID: ENST00000591472
  CDS Start-End: 174-555
aggctttgtggtgagagggcacagagtggaggaaggtgccgtggctagggcaggccacacgctgtgctaatggattgctgttacctgtcgcctctgtggttttgctgtcaggatcctccagcaccaggtccccaccaccagccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagccca

SEQ ID NO: 179996 - DNA, 553 bp, Homo sapiens
  Payload ID: 15455
  Gene Symbol: SEPT9
  Gene Name: septin 9
  ENST ID: ENST00000591934
  CDS Start-End: 100-553
atatatccgtaggaatggagagggaccggatctcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaac

SEQ ID NO: 179997 - DNA, 2919 bp, Homo sapiens
  Payload ID: 15455
  Gene Symbol: SEPT9
  Gene Name: septin 9
  Uniprot ID: Q9UHD8
  ENST ID: ENST00000588690
  CDS Start-End: 478-1746
tgctgggtggccttgagcaagccacttggcagctctgggccgcagttccgtcatctgcaagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcatggaggagaaggagccagaagccccggagatgtagacgccaccctgcccacccccgggatcctgcccccaagtcatttccgtccccccccaggccctcccaccaccccattttattttatatgattttctccatttgtcatcgttccccaccccttcgacatgctgccaggaaacaagggaaggggcctccctccgagtgagtcagtgatgaggccgcggcctccccgaggttgtggggaggctgcactggagccacaggcaggggtgagagcacccactgaattgacatgaccctctgtccccaggcctggctccccgagggctcagaagagcagcttcggtgtgcagatcatccgtctgtgtggggttctcagtgccggaggccttggggtgggggccaggcctcgcacttgcagaggagcccagtgggctgcacgctcccctccatccccatcggccctgtcccctggagtgtgtcagagcccaggggagaatgcagcccaccaggagcacctggaccccctgcccgccacatggtgtggccatcactcagcccctacccctgccctgctcctaagggtagaaaactccagggtcccctgccaccgactgcccagccactccaagccccctggcagctgcccctcctggagcagaaagtgcctttatctcagccatccgcagactgcttggccagatgcggggacaggctggaatgagggaggcgtcttcatctccctgccatccccctctcacgccacccccgcccccaccgggctgcaggtgctgctgatgcgctgggatctgattgaggataaaaaggaaggagagatgacccctaccccctcatcccccagttttgaaaaggtctaagcaaacagtttactttgccaacttgccatgtttttgccaaaaccaagattttgaaggaaatgagtggccagcgccagggcccaggccatgtggcctgcccagcctcaatgtcacttggtggcggggtggggtgggggtgggcagcagcatcccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaaccca

SEQ ID NO: 179998 - DNA, 238 bp, Homo sapiens
  Payload ID: 15455
  Gene Symbol: SEPT9
  Gene Name: septin 9
  ENST ID: ENST00000633557
  CDS Start-End: 208-238
aattagtcacttcttcctctgtacgttggaaacaccgctttatcgtggagactttaaggatatccaagtagagagaattcttccgtgcaagttttgcatcctctcaccactgcctgcgttacccgagttgtaaagggcggctccctgtgtctgccccgctgcaccgatacaccgagctgcgcacggtgcccagcgcagggagaacaaatgatcatctgtccaacgcgcccatttacag

SEQ ID NO: 179999 - DNA, 145 bp, Homo sapiens
  Payload ID: 15455
  Gene Symbol: SEPT9
  Gene Name: septin 9
  ENST ID: ENST00000634088
  CDS Start-End: 127-145
actccagacggcgggccgccccctcttcccgccttcctactaccggcccaggattagcgccctgggagcgcgcgccccgctgcctcgccgccacactttcctgggagcggcggccacggaggcaccatgaagaagtcttactcag

SEQ ID NO: 180000 - DNA, 248 bp, Homo sapiens
  Payload ID: 15455
  Gene Symbol: SEPT9
  Gene Name: septin 9
  ENST ID: ENST00000633211
  CDS Start-End: 100-234
cccgccttcctactaccggcccaggattagcgccctgggagcgcgcgccccgctgcctcgccgccacactttcctgggagcggcggccacggaggcaccatgaagaagtcttactcagatttgcttctggacccgtgcatttcaaatcttgcttctctccactgcgcacgtttttccggcgccaggcaccgcaggatatgttcgtgtcttgtgatttttgattctgcgcggtaggtggaattggaacg

SEQ ID NO: 180001 - DNA, 104 bp, Homo sapiens
  Payload ID: 15455
  Gene Symbol: SEPT9
  Gene Name: septin 9
  ENST ID: ENST00000632729
  CDS Start-End: 86-104
accggcccaggattagcgccctgggagcgcgcgccccgctgcctcgccgccacactttcctgggagcggcggccacggaggcaccatgaagaagtcttactcag

SEQ ID NO: 180002 - DNA, 2253 bp, Homo sapiens
  Payload ID: 15456
  Gene Symbol: SQSTM1
  Gene Name: sequestosome 1
  Uniprot ID: Q13501
  ENST ID: ENST00000360718
  CDS Start-End: 521-1591
gttagggaaggaagcaggcagatgcccttgtcttctcctttactcccaagccactagaagtctaaggcctttgtggggctgggcccctcaggagcaggtcacaggcagggatctcccacagttgaagacggacatgggcctggtcggatggggaatgaggtggcacgtttctgaaaaggcagctggcccaaggctaaataagtgcagcagccaaagctgctgcccctgtgcacaggccctccgccccctgcatgtggctgtggtccagggcccaggtcggagcactcaccttccaggaggtgccagagcaagggggtagtcttgcctctcactcctgccctctgtggctcaagtaggtgtgtttgtttatagccctgtgagtgtccctttcatacttgcctcagcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaat

SEQ ID NO: 180003 - DNA, 2986 bp, Homo sapiens
  Payload ID: 15456
  Gene Symbol: SQSTM1
  Gene Name: sequestosome 1
  Uniprot ID: Q13501
  ENST ID: ENST00000389805
  CDS Start-End: 179-1501
agagtagtgaaggggcctctgcagggcggctctcgcgccgcgacgacggtggcgggggcggggagggcgcgagagactccgcccctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggagtccgaggggcgccctgaggaacagatggagtcggataactgttcaggaggagatgatgactggacccatctgtcttcaaaagaagtggacccgtctacaggtgaactccagtccctacagatgccagaatccgaagggccaagctctctggacccctcccaggagggacccacagggctgaaggaagctgccttgtacccacatctcccgccagaggctgacccgcggctgattgagtccctctcccagatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgtaaacaatctaattaaatggcatcagcactttaaccaatgacgtttgcatagagagaaatgattgacagtaagtttattgttaatggttcttacagagtatctttaaaagtgccttaggggaaccctgtccctcctaacaagtgtatctcgattaataacctgccagtcccagatcacacatcatcatcgaagtcttccccagttataaagaggtcacatagtcgtgtgggtcgaggattctgtgcctccaggaccaggggcccaccctctgcccagggagtccttgcgtcccatgaggtcttcccgcaaggcctctcagacccagatgtgacggggtgtgtggcccgaggaagctggacagcggcagtgggcctgctgaggccttctcttgaggcctgtgctctgggggtcccttgcttagcctgtgctggaccagctggcctggggtccctctgaagagaccttggctgctcactgtccacatgtgaactttttctaggtggcaggacaaattgcgcccatttagaggatgtggctgtaacctgctggatgggactccatagctccttcccaggacccctcagctccccggcactgcagtctgcagagttctcctggaggcaggggctgctgccttgtttcaccttccatgtcaggccagcctgtccctgaaagagaagatggccatgccctccatgtgtaagaacaatgccagggcccaggaggaccgcctgccctgcctgggccttggctgggcctctggttctgacactttctgctggaagctgtcaggctgggacaggctttgattttgagggttagcaagacaaagcaaataaatgccttccacctcaccgcaaa

SEQ ID NO: 180004 - DNA, 628 bp, Homo sapiens
  Payload ID: 15456
  Gene Symbol: SQSTM1
  Gene Name: sequestosome 1
  ENST ID: ENST00000422245
  CDS Start-End: 208-628
agtggacgcggggagcctgcggggtgggactgcatcgggaaaggggaaggagtcagaggcgagaagggggagagtgtctgtctggctccagccgctgcacgctcttcctgctcaggggactcacggtgaccccggagccactccccagcccagcctccagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcag

SEQ ID NO: 180005 - DNA, 572 bp, Homo sapiens
  Payload ID: 15456
  Gene Symbol: SQSTM1
  Gene Name: sequestosome 1
  ENST ID: ENST00000453046
  CDS Start-End: 33-254
acggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtggtgggttcagataatgccctggaggagccgggcgagcgccggcgaggggagggagtgacgcgggtaaacaagcgcgggggtgcgggggactcgcgagcgccgcgacagcgcctgggagaagggcacggatcgccggcggaacgctccgagccagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctg

SEQ ID NO: 180006 - DNA, 578 bp, Homo sapiens
  Payload ID: 15456
  Gene Symbol: SQSTM1
  Gene Name: sequestosome 1
  ENST ID: ENST00000508284
  CDS Start-End: 60-269
aaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggcc

SEQ ID NO: 180007 - DNA, 1714 bp, Homo sapiens
  Payload ID: 15456
  Gene Symbol: SQSTM1
  Gene Name: sequestosome 1
  ENST ID: ENST00000510187
  CDS Start-End: 17-1153
cagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgggcattgaagttgatatcgatgtggagcacggagggaaaagaagccgcctgacccccgtctctccagagagttccagcacagaggagaagagcagctcacagccaagcagctgctgctctgaccccagcaagccgggtgggaatgttgagggcgccacgcagtctctggcggagcagatgaggaagatcgccttggaatgctgtccatgggcttctctgatgaaggcggctggctcaccaggctcctgcagaccaagaactatgacatcggagcggctctggacaccatccagtattcaaagcatcccccgccgttgtgaccacttttgcccacctcttctgcgtgcccctcttctgtctcatagttgtgttaagcttgcgtagaattgcaggtctctgtacgggccagtttctctgccttcttccaggatcaggggttagggtgcaagaagccatttagggcagcaaaacaagtgacatgaagggagggtccctgtgtgtgtgtgtgctgatgtttcctgggtgccctggctccttgcagcagggctgggcctgcgagacccaaggctcactgcagcgcgctcctgacccctccctgcaggggctacgttagcagcccagcacatagcttgcctaatggctttcactttctcttttgttttaaatgactcataggtccctgacatttagttgattattttctgctacagacctggtacactctgattttagataaagtaagcctaggtgttgtcagcaggcaggctggggaggccagtgttgtgggcttcctgctgggactgagaaggctcacgaagggcatccgcaatgttggtttcactgagagctgcctcctggtctcttcaccactgtagttctctcatttccaaaccatcagctgcttttaaaataagatctctttgtagccatcctgttaaatttgta

SEQ ID NO: 180008 - DNA, 602 bp, Homo sapiens
  Payload ID: 15456
  Gene Symbol: SQSTM1
  Gene Name: sequestosome 1
  ENST ID: ENST00000504627
  CDS Start-End: 33-602
acggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcgcccattccagcagcttatgtccagctgagaacccctgggtgctcacgtgctgtcttttaaacaatctagatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgca

SEQ ID NO: 180009 - DNA, 842 bp, Homo sapiens
  Payload ID: 15456
  Gene Symbol: SQSTM1
  Gene Name: sequestosome 1
  ENST ID: ENST00000514093
  CDS Start-End: 341-842
tccgcggccaccgccgggcccgctcccgccgccgacgcccaggtgcgccaggtgcgggccgggcgggggtcgcgctcacctttctggccgctgagtgccgcgtaccaggacagcgagaggaaggcgcacaggcagaagagcagcagcgtcaggaaggtgccattgcggagcctcatctcctcggtgtctgcgagattaatctctcatggccgctgcacaagaacctggcttttagctgaactaaggagaaagtcctacaacagtttggcgtgcaacatggggcttgagaaaggatgaggacggggacttggttgccttttccagtgacgaggaattgacaatggccatgtcctacgtgaaggatgacatcttccgaatctacattaaagagaaaaaagagtgccggcgggaccaccgcccaccgtgtgctcaggaggcgccccgcaacatggtgcaccccaatgtgatctgcgatggctgcaatgggcctgtggtaggaacccgctacaagtgcagcgtctgcccagactacgacttgtgtagcgtctgcgagggaaagggcttgcaccgggggcacaccaagctcgcattccccagccccttcgggcacctgtctgagggcttctcgcacagccgctggctccggaaggtgaaacacggacacttcgggtggccaggatgggaaatgggtccaccaggaaactggagcccacgtcctcctcgtgcaggggaggcccgccctggccccacggcagaatcagcttctggtccatcggaggatccgagtgtgaatttcctgaagaacgttggggagagtgtggcagctgcccttagccctctgg

SEQ ID NO: 180010 - DNA, 274 bp, Homo sapiens
  Payload ID: 15456
  Gene Symbol: SQSTM1
  Gene Name: sequestosome 1
  ENST ID: ENST00000626660
  CDS Start-End: 53-274
gcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccctgttccccgcgctgcggcctggcggcttccaggcgcactaccgcggtggtgggttcagataa

SEQ ID NO: 180011 - DNA, 1208 bp, Homo sapiens
  Payload ID: 15457
  Gene Symbol: SRGN
  Gene Name: serglycin
  Uniprot ID: P10124
  ENST ID: ENST00000242465
  CDS Start-End: 41-517
gaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgttcgaactacttccaggtgaatccaacaagatcccccgtctgaggactgacctttttccaaagacgagaatccaggacttgaatcgtatcttcccactttctgaggactactctggatcaggcttcggctccggctccggctctggatcaggatctgggagtggcttcctaacggaaatggaacaggattaccaactagtagacgaaagtgatgctttccatgacaaccttaggtctcttgacaggaatctgccctcagacagccaggacttgggtcaacatggattagaagaggattttatgttataaaagaggattttcccaccttgacaccaggcaatgtagttagcatattttatgtaccatggttatatgattaatcttgggacaaagaattttatagaaatttttaaacatctgaaaaagaagcttaagttttatcatccttttttttctcatgaattcttaaaggattatgctttaatgctgttatctattttattgttcttgaaaatacctgcattttttggtatcatgttcaaccaacatcattatgaaattaattagattcccatggccataaaatggctttaaagaatatatatatatttttaaagtagcttgagaagcaaattggcaggtaatatttcatacctaaattaagactctgacttggattgtgaattataatgatatgccccttttcttataaaaacaaaaaaaaaaataatgaaacacagtgaatttgtagagtgggggtatttgacatattttacagggtggagtgtactatatactattacctttgaatgtgtttgcagagctagtggatgtgtttgtctacaagtatgattgctgttacataacaccccaaattaactcccaaattaaaacacagttgtgctgtcaatacctcatactgctttacctttttttcctggatatctgtgtattttcaaatgttactatatattaaagcagaaatataaccaaaggttaa

SEQ ID NO: 180012 - DNA, 1907 bp, Homo sapiens
  Payload ID: 15458
  Gene Symbol: SERAC1
  Gene Name: serine active site containing 1
  Uniprot ID: Q96JX3
  ENST ID: ENST00000367101
  CDS Start-End: 122-1717
gtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaggagtttgctgtcaataagcagtggaatagtagaaggcttagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaa

SEQ ID NO: 180013 - DNA, 3948 bp, Homo sapiens
  Payload ID: 15458
  Gene Symbol: SERAC1
  Gene Name: serine active site containing 1
  Uniprot ID: Q96JX3
  ENST ID: ENST00000367104
  CDS Start-End: 133-2097
gagggggcggggtcacgagccgccagccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaatttatgtgtggatagatgtttttgattctcttgggtggaattgctggtcaaatggtaagtctatgtttaaattttgaagatggtgaacttttgtagaatgagatagtcgaagctaaaactggagtatggcatctgaaggtaaatggctcatcaataaactcgatatcaacaattaa

SEQ ID NO: 180014 - DNA, 507 bp, Homo sapiens
  Payload ID: 15458
  Gene Symbol: SERAC1
  Gene Name: serine active site containing 1
  ENST ID: ENST00000435180
  CDS Start-End: 1-489
gatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaagaagaaaaagtttcttccttgaatgtattatctcatttta

SEQ ID NO: 180015 - DNA, 5155 bp, Homo sapiens
  Payload ID: 15458
  Gene Symbol: SERAC1
  Gene Name: serine active site containing 1
  ENST ID: ENST00000607742
  CDS Start-End: 109-237
agccgccgggtggagggtcccggccgggagccgcggaaagagtagggctccccagacaacggggtccgacgagcagttgggcacgggctgagtccgcctgccggcagaatgtccctggctgcttattgcgtcatctgttgcagaagaataggaacctctacttccccaccaaaaagtggcacacactggagagatatcaaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaaggtaacagaggcgactttagaccaggaggacagggaagaattcaggccgcaagtttaggtcctcttggatgggaagtgattttaattttttgatgccacagacaggattttcttatgaagaacaaacctaatcttttttgtcttccttctagaaggagtttgctgtcaataagcagtggaatagtagaaggcttaggtatatcaccaatggtgggctcctaacatggtttatttacaactgttctaatagtgaaggatcgtggattgtctagcagtctccttttctatcagaagtaaaagtgatgtttttttgttcttgtgtccacaatcatactggctaaaggaagcaaagagaaagatgctgagaaatatcagctgctatttcccttgtatgtcatctgtgccagttgtatacatgggaaggagtgctggatttcagagttactggactgagagtagccggatcctacctttgatttgctgtgcagtcttagaccagtcagttaacttttccgggaagctttgtctacagattgacagagttggtctaaatcagtgttatcaaactgctttctgaatgaacctcccgtaggtgcccaagaagggtgtcaaggtgagcaggcaagaccccaggtctccctccccatttcacccagaggagctctggagaacctttattttgaagaaatgtgtctacaaataaacagtttgaaactaccagactagatagttttgaagttcctctttagtttaaaaattacttatttcgaattctgattctattagcatcctgtttatgctagttataaaagcatgcattggaaggaataagtgctaataaacttgactcattctagtttttctaaatagcaccctagtatttctaaagaataaaccaaaattatgaaagcttaatatttttgcagcctaactaccagtagagagaccacagtctttggtgatactttcattgtcaggccttggatgaaaaaggacatccatatcctaagtgttggagggcagttgcagggagacccacatttgacccgaaaaaattgcctgacacaggtgctccaacaatgttcatgcagtaaatgaatggcctgttctgggcttagatattcctaattaggccaatgttaataagttacaaatagagaattaacgatttcaggaattgagcagagagatcccaggcgtggtggctcatgcctataatcctagtgctttgggaggccgaggtgggaggattccttggggccaggagttcaataagagagaataggggtattttatattaagcagagagaatgggggtatttcttactctaaatgtagtatgtagcattggtcctgtagactaaagttcttaactctaaaaattagacagcaaattgaggggatcgatagccttgtgtcatgcctgctgtttttgttttgttcagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccattatatgaattagcaattcttagtatcaagattctcagattctctttggctaaataaacctttcttcttccttgctcatttgcaagtggtattaattgacctctatagcatgtgagtagtagataatcatgtcgatgacctttttttctttagagtaacagcattattgagatataatttacataccataagattcacccttttaaattatacaattcatttttgttttgttttgtttgtttagagacagggtctgactctgttgcccaagctggagtgcagtggcatgatcatagctcattgtaacctcaaactcctgggctcaagagatccttttgcttcagcctcccaagcagctaggactacaggcacatgccaccacacttgggtaattaaaaaataaataaatacttttttgtagagacagggtctcactgtgttgcccaggtctcaaactcccgatctcaagccaccctcccaaaatgctgtgattataggccagagccattgttcccaggctcaattcattggtttttagtatagttcactgagttgtgcaacatcattgctatttaatttcaggctatttcatcatccccaaaagaaccccatacccatgagcagtcagttcccacctctgctttcccaagcctgcggtaaacactaatctgttttctgtctctatggatttgggaattttatgtaaatggaatcatacaatatgtggccctctctgccttcttccttctattagcatgttttcaaggttcattcatgatatagcatgtatcagtactacttcatttctttttatggccgaaattactccattgtatgatatgccatgtttctttatccattcatcagctgatggacatctaggttctgttcatttttgtctatgataaataatgctaccatgatcatttgtgtacaaa

SEQ ID NO: 180016 - DNA, 2284 bp, Homo sapiens
  Payload ID: 15458
  Gene Symbol: SERAC1
  Gene Name: serine active site containing 1
  Uniprot ID: Q96JX3
  ENST ID: ENST00000607000
  CDS Start-End: 936-1439
ctcctgagctcacgtgatctgcccacctcagcctcccaatgtgctgggattataataatttctagtgttaaatgcatttgtgaaagaacaagaaatgctcatcttaggcattattgaagaagttaggaaaaggacaggatgcacccaaagaaagaaagaagaaaataataaaaagcagaaatagaaaacaaaacaaaagagagaggtaccttcaaggtaccttccttcctttcccttatagcaaaaggaaaaagaaaaaaaaacctcactatccaaagacaacctgatatgggtctagaatactgagttgtgttctgggaatgattgcagcatatgatcatctttactcagttgatgaattaggtggatgacagctctcctttgatagaatgccaacaatgaacaaatttcaaaaattttaaacaacgtgggtactatcctgaaagaactagagaaaagctaaatgcttctatggattctaagtgtaccgtccacatagagcttctcatttctgtggggacttcagtcatcagagataaatacatatatacatatattttcaaagacattaaatttttttcatgcctatattggtattctgattaatagtctgtctattcttgttaccgtttaattcttgtgttctgggaatgattgtatcatatttagatcatctttccaattgtgaaaactatgcacaattggacacagtgtgaggaagaataatgaaaattctaacaaaatattattctaataagtcccttttaagtttttaatggagaattttttttttaattggaaagttttcttcgtagtcttgaaaaagctaactctgtgggtcatccactgtgatggtaacatgttcttgtagttaaaacaagtgttttgatttagatgctaaattaaatttgttgtaattgttctacttacacagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatggtaatgagactacctgaacaggtggcatgccttcagctggctcttgattgctgacataaaagacaagggagtggccaggtgcggtggctcacgcctgtaatcccagcactttgggaggccacgctggttggatcacaaggtcaggagttcaagacccaccctggctaacatggtgaaaccccgtctctactaaaaatacaaaaaaattagccaggcatggtggcgggcgtctgtagtcccagctactcgagaggctgaagcaggagaatggcgtgaacccaggaggcagagcttgcagtgagccgagattgcgccactgcactccagcctgggcaacagagcgagactccatctcaaaaaaaaaaaaaaaaaaaaaaaaaaaagacaagggagtgggagtgagattcaggaaggaaaataattcaggcagtgttagtatatatagaaagtatttgaaaaattttaagaagcttcagtgatacggaaagtagaaagcctgctgaactggtagtcaaatgtgtttggtaagaataagctcaaaaatgaggtatatatatttgtgtaactttctaccagaacaaagttttatttggttacatacttctttgagagcaactcttgattctgatagttacctaatgtacttgagttttcttttggtttctatttaatgaagtacatttaattgcttgctacaccatacaattatgtttgcttttacttttacaatctacttggctctaatactaatagtcgaatgtacccaatttgtatttgtgtatatcatttttaatggactatttgaaatatgtaattgtgtttaaaaatcacaaattttacaataaaaatatttttaaaagaa

SEQ ID NO: 180017 - DNA, 1826 bp, Homo sapiens
  Payload ID: 15458
  Gene Symbol: SERAC1
  Gene Name: serine active site containing 1
  ENST ID: ENST00000606965
  CDS Start-End: 34-1263
gttgggcacgggctgagtccgcctgccggcagaatgtccctggctgcttattgcgtcatctgttgcagaagaataggaacctctacttccccaccaaaaagtggcacacactggagagatatcagaaatataataaagtttactggatcacttattttaggaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaagggtaatactttttgtcataaaggaaattggggttatattaacatcagttacacagagaagaagaaaaagtttcttccttgaatgtattatctcattttataatttgtatataattgtgtttagactattcatggaaattttgggttgggcttgatttttctttgataatttctcattttgttcttaagccattatttactcaagcattgtaataattttaatattatcttaaatacttaaaattagaaaaataatcagataatgttttgcttttaagtattattccaaattaccaataaatggcttttttcccccatga

SEQ ID NO: 180018 - DNA, 4035 bp, Homo sapiens
  Payload ID: 15458
  Gene Symbol: SERAC1
  Gene Name: serine active site containing 1
  ENST ID: ENST00000607071
  CDS Start-End: 1269-1397
aacagtttccagataaagacctaaatgtgaatggcacagctgcaaggaatggtaagaagacagacacagagacaactgccttgaaagaagagcttattatgtacagttcccaaggaagagtgggcgtgccacaccatgcaaggccacatggggaagtaccagggtcattcaggaggcataaggagcaatgtgaaagcatgggccagagctttcttttattgtgtttttttgtgggaaggaatgaacgttttttttgtgggaaggaatgagcgagacagggtagacgagctgaacaaacttaggattggatagttcgaataatttggcagaccagagaggtggtctctagctgcctagtacctggctctgaggagatttagagtaagggaagcattggctgtgtgtggtggttgggggtatgcacctgggattggttggtttgcatatgagaagcatgctcacaggcaggttgtttgctacctctagcagttagctatcccagagaggggcagtcactccctgggtccttaaggtcctaagatgtcaaagcattcttaaaaaaaaaaaaaaaattactaatacaagttgtttgtggaattggatttgaaaccaggcagtgtggtcctacagagcacattcttaaacttctttgctattattttgcctacaaagaaacaacagttagacttagatttctcctgagcaacaagaaatatcagtgaaaataccattaatgtaccaaaggaaacctactgttattctaaattctaaacccagaattccaaacccagctattactatttttttttttttttctgagacagagtcttactctgtctcccaggctaaagtgtagtgcgtgatcatggctcactgaaacctctgtctcccaggctcaagcaattcctctgcctcagcctcccgagtagctgggaatacaggcacatgccaacaggcccagctaattttttaaatttttttggagagatgaagtctcactggtcttgaactcctgggctggcctagagctcctgggctcaagcagtctgcccaccttggcctccaagtgctgggattgcaggcatgagtcaccacgcctggcccaaacacaactattttttagtatatctaaaatagagcatttttagacatgctgagagtgagagtgctaactacatatatgccttcatgaaggaactatcaaaggatataccttcatcaagaatgatttgaacctaggaggaagttgtggatgcaagaaacaaaaaatgtccctggctgcttattgcgtcatctgttgcagaagaataggaacctctacttccccaccaaaaagtggcacacactggagagatatcaaggttctttatttcttacatatgaagttctggccctgaagaaggctgtgacattagatactcaagtggtagaacgagaaaaaatgaagtcatatatatatgtgcacacagtttctttagacaaaggagaaaatcatggtattgcctggcaggcaagaaaagaacttcacaaagcagtaagaaaagtattggcaacatcagccaagatactgcggaatccatttgctgatccttttagtacagttgatatagaagatcatgagtgtgctgtgtggctgctcctacggaagagcaagtcagatgacaaaaccacgcgactcgaggctgtgcgggaaatgtcggagacccatcactggcatgggctccattccagacttattgtatcagagaaatcagaggaagtgccctggcccacagattttggaaaagttccccacttgatccagaagtactcacccagattaccagtataggataattgctcaagcctgtgatccgaaaactcttattggtttggcacgaagcgaagagagtgatcttcgcttttttctcctaccacctcctttgccatctttaaaagaagattcttccactgaagaagagctcagacagttgctggcttccttacctcaaacagagctagatgagtgtatccagtattttacatctttggctcttagtgaaagcagtcagagtctagctgctcagaagggtggtttatggtgttttggaggaaatggacttccttatgctgaaagttttggagaagttccttcagcaacagtggaaatgttctgtttagaagctatagtaaaacattctgagatatccacacattgtgataaaatcgaagcaaatggaggcctgcagctacttcagaggctgtaccgacttcacaaggactgccctaaagtacagagaaatataatgcgtgtcattggaaatatggctttgaatgaacatcttcattcttctatagttcgctcaggctgggtttccatcatggcagaagcaatgaaatctccccacattatggagtcctcacacgctgccagaatcctggcaaatctagaccgagaaactgtgcaagaaaaatatcaggatggcgtatatgtgctgcatccccaatatcgaacaagtcagcccattaaagcagatgtcctttttattcatggccttatgggagcagcattcaaaacatggcgccagcaggacagtgagcaggctgtaattgaaaaacctatggaggatgaagacagatatacgacgtgctggcccaagacatggttagcaaaagactgtcctgctctccgaattatatctgtggagtatgacaccagcctcagcgactggagagcaaggtgccctatggaaagaaagtccattgcattcagaagcaacgaacttcttaggaagctcagagctgctggtgttggggataggccagtggtttggatatcacatagcatgggaggtcttcttgtcaaaaagatgctgttggaagcctctacgaagccagaaatgagtactgttatcaacaataccagaggaataattttttatagtgtccctcatcatggatcacgtttggctgaatactctgttaatattcgctatcttctcttcccctcgttggaagtcaaagaactcagcaaggattctcctgcacttaaaacactacaagatgactttctggagtttgctaaagacaaaaacttccaggtgctgaattttgtggaaacactaccaacctacattggcagcatgattaagctccatgtggtacctgtggaatcagcagatttaggcattggagatctaattcctgtggatgttaaccatttgaacatttgtaagccaaagaaaaaggatgcttttttgtaccagcgtactttacaattcattcgtgaagctttagccaaagaccttgaaaactaacagttgtgctcttccagttttcatatgtgaattcagtgcaagaaacttggtgttctgtttcttcttttaagctctatgcaatcatgcaaacatagtgatcatagcgtcaacatggtctggagtgtgttgcagactacagaacattgttctcccttcaagcgctgtaaagcaccaacccggaagtggcaggcacagaaggaagggctggattgggcccctttggtgtaaagaagtccctgtgtgctgctttatggttcgcagtgttgggcttggtgactggagcaaagctgctgtgagagagtgtcctttcccatctgtgactttcctggtgcatccaggaggggcacggcaggttctgaggtaactcaacttaccataaaaatgccattaagagagtacctaaaatggagagaagaatgaactagaacattcaagactcttttacttctgggtattgatttgctgtacatttttaaagtttgagtttttagctcagttctaccttttatctgacacattattactagtgttaactttgttagacttattgtcatgtctgggtcagttccttgtatctattttcgtattcctgagaacaaatctttttcttagaaaaattctagcttataataattcttttcagactgtagctgcctatgcttggaatttgtcctagataaggataaagtagctaatccattattgatcacagtatgaagtaaaactattctaagccatt

SEQ ID NO: 180019 - DNA, 1942 bp, Homo sapiens
  Payload ID: 15459
  Gene Symbol: SCPEP1
  Gene Name: serine carboxypeptidase 1
  Uniprot ID: Q9HB40
  ENST ID: ENST00000262288
  CDS Start-End: 56-1414
acgtgatggggcgccgggtccagcctgttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatt

SEQ ID NO: 180020 - DNA, 1915 bp, Homo sapiens
  Payload ID: 15459
  Gene Symbol: SCPEP1
  Gene Name: serine carboxypeptidase 1
  Uniprot ID: Q9HB40
  ENST ID: ENST00000576154
  CDS Start-End: 13-903
gcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttggttttagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctctaacatttttaa

SEQ ID NO: 180021 - DNA, 1725 bp, Homo sapiens
  Payload ID: 15459
  Gene Symbol: SCPEP1
  Gene Name: serine carboxypeptidase 1
  ENST ID: ENST00000575423
  CDS Start-End: 32-241
ctgttgctgatgctgccgtgcggtacttgtcatggagctggcactgcggcgctctcccgtcccgcggtggttgctgctgctgccgctgctgctgggcctgaacgcaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaactaaaagcactcccacgtctacaatggagtcgagtctagaattcacacagagccacctagtttgtctttgtcagcgccacgtgagacacctacaacgagatgccttaagccagctcatgaatggccccatcagaaagaagctcaaaattattcctgaggatcaatcctggggaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgtta

SEQ ID NO: 180022 - DNA, 579 bp, Homo sapiens
  Payload ID: 15459
  Gene Symbol: SCPEP1
  Gene Name: serine carboxypeptidase 1
  ENST ID: ENST00000572591
  CDS Start-End: 30-473
gttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaac

SEQ ID NO: 180023 - DNA, 555 bp, Homo sapiens
  Payload ID: 15459
  Gene Symbol: SCPEP1
  Gene Name: serine carboxypeptidase 1
  ENST ID: ENST00000572710
  CDS Start-End: 27-555
gctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttg

SEQ ID NO: 180024 - DNA, 930 bp, Homo sapiens
  Payload ID: 15459
  Gene Symbol: SCPEP1
  Gene Name: serine carboxypeptidase 1
  ENST ID: ENST00000573239
  CDS Start-End: 1-407
ctacaatggagtcgagtctagaattcacacagagccacctaggccaggctaccaacgtctttgtgaacatggaggaggacttcatgaagccagtcattagcattgtggacgagttgctggaggcagggatcaacgtgacggtgtataatggacagctggatctcatcgtagataccatgggtcaggaggcctgggtgcggaaactgaagtggccagaactgcctaaattcagtcagctgaagtggaaggccctgtacagtgaccctaaatctttggaaacatctgcttttgtcaagtcctacaagaaccttgctttctactggattctgaaagctggtcatatggttccttctgaccaaggggacatggctctgaagatgatgagactggtgactcagcaagaataggatggatggggctggagatgagctggtttggccttggggcacagagctgagctgaggccgctgaagctgtaggaagcgccattcttccctgtatctaactggggctgtgatcaagaaggttctgaccagcttctgcagaggataaaatcattgtctctggaggcaatttggaaattatttctgcttcttaaaaaaacctaagattttttaaaaaattgatttgttttgatcaaaataaaggatgataatagatattattttttcttatgacagaagcaaatgatgtgatttatagaaaaactgggaaatacaggtacccaaagagtaaatcaacatctgtatacccccttcccaggggtaagcactgttaccaatttagcatatgtccttgcagaatttttttttctatatatacatatatattttttaccaaaatgaatcattactctatgttgttttactatttgtttgacatatcagtatatctgaaacaccttttcatgtcaataaatgttcttctcta

SEQ ID NO: 180025 - DNA, 572 bp, Homo sapiens
  Payload ID: 15459
  Gene Symbol: SCPEP1
  Gene Name: serine carboxypeptidase 1
  ENST ID: ENST00000575395
  CDS Start-End: 286-572
gctgatgctgccgtgcggtacttgtcatggagctggcactgcggcgctctcccgtcccgcggtggttgctgctgctgccgctgctgctgggcctgaacgcagggcggtccaggcggttctagcactggatttggaaactttgaggaaattgggccccttgacagtgatctcaaaccacggaaaaccacctggctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaa

SEQ ID NO: 180026 - DNA, 444 bp, Homo sapiens
  Payload ID: 15459
  Gene Symbol: SCPEP1
  Gene Name: serine carboxypeptidase 1
  ENST ID: ENST00000631024
  CDS Start-End: 1-444
atggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactga

SEQ ID NO: 180027 - DNA, 1606 bp, Homo sapiens
  Payload ID: 15460
  Gene Symbol: SDS
  Gene Name: serine dehydratase
  Uniprot ID: P20132
  ENST ID: ENST00000257549
  CDS Start-End: 124-1110
ggaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctgggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgtgcctgtcatcgccatggagacttttggtgcccacagcttccacgctgccaccaccgcaggcaaacttgtctccctgcccaagatcaccagtgttgccaaggccctgggcgtgaagactgtgggggctcaggccctgaagctgtttcaggaacaccccattttctctgaagttatctcggaccaggaggctgtggccgccattgagaagttcgtggatgatgagaagatcctggtggagcccgcctgcggggcagccctggccgctgtctatagccacgtgatccagaagctccaactggaggggaatctccgaaccccgctgccatccctcgtggtcatcgtctgcgggggcagcaacatcagcctggcccagctgcgggcgctcaaggaacagctgggcatgacaaataggttgcccaagtgaggacggaccccttaccgatctgtgctctcctagcccaagagacccctggaggggctggagttttatccagcgcctcgtcgtatgtttggctgagcacctgtggcctgggtgcaggttaacttcttgttatcaggagcccactatgcagaggccaaaggtcggcagccagcgaggctatgaattggacctttttggtatctgtgtgactgctctgtgcccatccttagccaacttgctggcgtgacaagtgcccacaagtaacacaccaggtacccagagcagggtggacaggagagacctgaatcacagcagtgaggaattcctcaaagctgtgacctcgcccctgaacttgttcccagtgaaggtcaacagggccaccaaccagggttgaggaaccatctcagccatcctcccaggaagcccacccctgacccttactaatttttctaatgtgcaaactttttcattgaaaaataaaatatatttatgaaacaaa

SEQ ID NO: 180028 - DNA, 736 bp, Homo sapiens
  Payload ID: 15460
  Gene Symbol: SDS
  Gene Name: serine dehydratase
  ENST ID: ENST00000547342
  CDS Start-End: 30-736
ctgtacgttcttgaaaggggaactttgaaatggatgacaggaagagagccaagaggaaaagttcctacagagaacagcagccaggaccacctcgagggagaaatgcactttggggtgccgcggatgcagacagaaggggtttggggcaggagagacggggtttcaccatgttggctggtctcaaactcctgagctcaagtgatctgcccacctcggcctcccgaagtgctgggactacatccgtgagccaccgcgctcagccctttgagaggtttgaagccgaggagctgtgtgtgaatggaccagtgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggtgggccaagcaaggctgtgcacattttgtctgctcctcggcgggcaacgcaggcatggcggctgcatatgcggccaggcaactcggcgtccccgccaccatcgtggtgcccagcaccacacctgctctcaccattgagcgcctcaagaatgaaggtgccacagtcaaggtggtgggtgagttattggatgaagccttcgagctggccaaggccctagcgaagaacaacccgggttgggtctacattcccccctttgatgaccccctcatctg

SEQ ID NO: 180029 - DNA, 412 bp, Homo sapiens
  Payload ID: 15460
  Gene Symbol: SDS
  Gene Name: serine dehydratase
  ENST ID: ENST00000552280
  CDS Start-End: 122-412
accattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggcattgggcacttctgcaagaggggaaggccacgcttccatcgtgaaagagctgaaggagacactgtgggaaaagccgggggccatcgcgctgtcagtgggcggcgggggcctgctgtgtggagtggtccaggggctgcaggaggtgggctggggggacgt

SEQ ID NO: 180030 - DNA, 1397 bp, Homo sapiens
  Payload ID: 15461
  Gene Symbol: SDSL
  Gene Name: serine dehydratase-like
  Uniprot ID: Q96GA7
  ENST ID: ENST00000345635
  CDS Start-End: 211-1200
ctggttccctggcaggctggagggcaggagctggggccacgctggtctgggatagttgggcagggagacggagtctcgatctgtcacccaggctggagtgcagtggcacaaccttggctcactgcaacctccgcctcccaggttcaagtgattctcctgcctcagccttctgagtagctggaattacaagctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 180031 - DNA, 1449 bp, Homo sapiens
  Payload ID: 15461
  Gene Symbol: SDSL
  Gene Name: serine dehydratase-like
  Uniprot ID: Q96GA7
  ENST ID: ENST00000403593
  CDS Start-End: 263-1252
ggtgcatgagtcataggcagtgcccgggaaagcggtgagggttgctctcatcccctctcctcctccgtcttcacccggaggcttagggtctggagctttctctttaacaaaggaggagggaccaaggttgccggaagctgcctgaagctggacagagccggttcctggaaagagctggttccctggcaggctggagggcaggagctggggccacgctggtctgggatagttgggcagggaggctgtctacctggtctccagaatggacggccctgtggcagagcatgccaagcaggagccctttcacgtggtcacacctctgttggagagctgggcgctgtcccaggtggcgggcatgcctgtcttcctcaagtgtgagaatgtgcagcccagcggctccttcaagattcggggcattgggcatttctgccaggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctccgacaactccggccaataaacactttctgaattga

SEQ ID NO: 180032 - DNA, 544 bp, Homo sapiens
  Payload ID: 15461
  Gene Symbol: SDSL
  Gene Name: serine dehydratase-like
  ENST ID: ENST00000547802
  CDS Start-End: 457-544
tggtctgggatagttgggcagggaggtaaggggtctggggccagctggggcccctggggctcagtgtgtgtgtgaatgagaggctgatgagaggctgcaggagtttgggaggctttgggcaaagtccaagctgagcaggtgggagtgagagggcctgagcgtgttctaggccctcctgggaatgtcgattgaattcagggtgccctgcagaagaaagtgttgtgctggggaccctgaagggcgagagtgggttctgcctgccagaggggcagggttgggcattctgccagccaaggggccagcccgaggtgtcccagccctggcaccagggatttggctgtggagtgccaccaaggtggcctctggggaaaggctttggggacaagtgaggtggacagcactggtggtccttacctcaactcatagatgtgacaggctgtctacctggtctccagaatggacggccctgtggcagagcatgccaagcaggagccctttcacgtggtcacacctctgttggagagctgggcgctgtcccaggtgg

SEQ ID NO: 180033 - DNA, 589 bp, Homo sapiens
  Payload ID: 15461
  Gene Symbol: SDSL
  Gene Name: serine dehydratase-like
  ENST ID: ENST00000553248
  CDS Start-End: 74-589
aaagagctggttccctggcaggctggagggcaggagctggggccacgctggtctgggatagttgggcagggagatggccaagaagggatgcagacacctggtgtgctcctcagggggtaatgcgggcatcgctgctgcctatgctgctaggaagctgggcattcctgccaccatcgtgctccccgagagcacctccctgcaggtggtgcagaggctgcagggggagggggccgaggttcagctgactggaaaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggt

SEQ ID NO: 180034 - DNA, 409 bp, Homo sapiens
  Payload ID: 15461
  Gene Symbol: SDSL
  Gene Name: serine dehydratase-like
  ENST ID: ENST00000551760
  CDS Start-End: 1-183
aatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctgggtgagtgatccctgtcctccacctgggctcagagacccacgaagtccctgcatcctctagcaagagtgtgttctgtcttatctgtatcctcagcaccaggcactggctaggtgtgcagttactgtgcactaagtgcacgtcgagtagatggaagggggtgaggataaagaaggagtgtatcttgctgtctctagcccccagactttcatacatgctgctcctctctctggctgg

SEQ ID NO: 180035 - DNA, 839 bp, Homo sapiens
  Payload ID: 15461
  Gene Symbol: SDSL
  Gene Name: serine dehydratase-like
  ENST ID: ENST00000546672
  CDS Start-End: 1-677
gatggccaagaagggatgcagacacctggtgtgctcctcaggtctgggacgaggccaatctgagggcgcaagagttggccaagagggacggctgggagaatgtccccccgtttgaccaccccctaatatggaaaggccacgccagcctggtgcaggagctgaaagcagtgctgaggaccccaccaggtgccctggtgctggcagttgggggtgggggtctcctggccggggtggtggctggcctgctggaggtgggctggcagcatgtacccatcattgccatggagacccatggggcacactgcttcaatgcggccatcacagccggcaagctggtcacacttccagacatcaccagtgtggccaagagcctgggtgccaagacggtggccgctcgggccctggagtgcatgcaggtgtgcaagattcactctgaagtggtggaggacaccgaggctgtgagcgctgtgcagcagctcctggatgatgagcgtatgctggtggagcctgcctgtggggcagccttagcagccatctactcaggcctcctgcggaggctccaggccgagggctgcctgcccccttccctgacttcagttgtggtaatcgtgtgtggaggcaacaacatcaacagccgagagctgcaggctttgaaaacccacctgggccaggtctgaggggtcccatcctggccccaaagacccctgagaggcccatggacagtcctgtgtctggatgaggaggactcagtgctggcagatggcagtggaagctgccctgtgcaactgtgctggctgcctcctgaaggaagccctcctggactgcttcttttggctctc

SEQ ID NO: 180036 - DNA, 1374 bp, Homo sapiens
  Payload ID: 15462
  Gene Symbol: SERHL2
  Gene Name: serine hydrolase-like 2
  Uniprot ID: Q9H4I8
  ENST ID: ENST00000327678
  CDS Start-End: 103-1047
ggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctca

SEQ ID NO: 180037 - DNA, 753 bp, Homo sapiens
  Payload ID: 15462
  Gene Symbol: SERHL2
  Gene Name: serine hydrolase-like 2
  Uniprot ID: Q9H4I8
  ENST ID: ENST00000335879
  CDS Start-End: 1-753
atgagtgagaacgccgcaccagacttttattacgttgccatggatttcggaggtcatgggctctcgtcccattacagcccaggtgtcccatattacctccagacttttgtgagtgagatccgaagagttgtggcaggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtag

SEQ ID NO: 180038 - DNA, 1315 bp, Homo sapiens
  Payload ID: 15462
  Gene Symbol: SERHL2
  Gene Name: serine hydrolase-like 2
  ENST ID: ENST00000340239
  CDS Start-End: 160-771
ctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctc

SEQ ID NO: 180039 - DNA, 521 bp, Homo sapiens
  Payload ID: 15462
  Gene Symbol: SERHL2
  Gene Name: serine hydrolase-like 2
  Uniprot ID: Q9H4I8
  ENST ID: ENST00000407614
  CDS Start-End: 7-411
agagcgatgagtgagaacgccgcaccaggtctgatctcagagcttctcctgcaaagaggaaccacgaaggtggccacaggtctggttctgaacagagaccagaggctcgcctgggcagagaacagcattgacttcatcagcagggagctgtgtgcgcattccatcaggaagctgcaggcccatgtcctgttgatcaaagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtc

SEQ ID NO: 180040 - DNA, 563 bp, Homo sapiens
  Payload ID: 15462
  Gene Symbol: SERHL2
  Gene Name: serine hydrolase-like 2
  ENST ID: ENST00000447870
  CDS Start-End: 265-563
aactcgctgtggttgctccccgggtctggtcccgcgcggacgtgggggcggccatcaggactgcccgggggttggcgccctgctgggttccaagccggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctc

SEQ ID NO: 180041 - DNA, 1669 bp, Homo sapiens
  Payload ID: 15462
  Gene Symbol: SERHL2
  Gene Name: serine hydrolase-like 2
  ENST ID: ENST00000416156
  CDS Start-End: 104-499
aggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcgctcttttgtcccccaggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtttcgccatgttggccaggctgctctccatctcctgacctcatgatccgcccgcctcggcctcccagtgttgggattacaggcgtgagccaccgtgcgtggcccaccatagacgatttttaagccataaaaagaaacgaagcactgacacgggctccagcatggatgagcctttaaaacatcgcgctaagtggacgaattcagacacaaccgtctacgtgttgtatggctgcattcacgttcaagtcaagtccaaatagggcacactgcagagacaaagccagagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgt

SEQ ID NO: 180042 - DNA, 2096 bp, Homo sapiens
  Payload ID: 15462
  Gene Symbol: SERHL2
  Gene Name: serine hydrolase-like 2
  ENST ID: ENST00000477564
  CDS Start-End: 163-792
cttctgagtgggggcggggactgctggagttgcggggcctgcctggggtagggcggggcaggacagcttggagatagggcccggaattgcgggcgtcactctgctcctgcgacctagccaggcgtgagggagtgacagcagcgcattcgcgggacgagagcgatgagtgagaacgccgcaccaggtctgatctcagagctgaagctggctgtgccctggggccacatcgcagccaaagcctggggctccctgcagggccctccagttctctgcctgcacggctggctggacaatgccagctccttcgacagactcatccctcttctcccgcaagacttttattacgttgccatggatttcggaggtcatgggctctcgtcccattacagcccaggtgtcccatattacctccagacttttgtgagtgagatccgaagagttgtggcagccttgaaatggaatcgattctccattctgggccacagcttcggtggcgtcgtgggcggaatgtttttctgtaccttccccgagatggtggataaacttatcttgctggacacgccgctctttctcctggaatcagatgaaatggagaacttgctgacctacaagcggagagccatagagcacgtgctgcaggtagaggcctcccaggagccctcgcacgtgttcagcctgaagcagctgctgcagaggttactgaagagcaatagccacttgagtgaggagtgcggggagcttctcctgcaaagaggaaccacgaaggtggccacaggcagagaacagcattgacttcatcagcagggagctgtgtgcgcattccatcaggaagctgcaggcccatgtcctgttgatcaagtaagtctggacccatccccttcagccacccgccaaggagacatgggcgccaggaatctccgggagggggccctggcatgaggctccaagttctctgcgtgtcgaccacatcgctaaggctcaagatcttttttgggaagcccccctggcagcagggtcatggaaggaggaaggtcagaggaggggagggctcgggcagcaggggatgggccggggctgtcccatgcctttccacaggtgtcagcggggggcatgcccaggtaaggctccataaccagtgagcccagtctcggctgactgcaacctctgtctcctggattcaaacgattctcctgcctcagcctcccgagtagctgggactacaggcgcccgccaccaggcctggcttatttttgtatttttagtagagacgaggtttcgccatgttggccaggctgctctccatctcctgacctcatgatccgcccgcctcggcctcccagtgttgggattacaggcgtgagccaccgtgcgtggcccaccatagacgatttttaagccataaaaagaaacgaagcactgacacgggctccagcatggatgagcctttaaaacatcgcgctaagtggacgaattcagacacaaccgtctacgtgttgtatggctgcattcacgttcaagtcaagtccaaatagggcacactgcagagacaaagccagagcagtccacggatattttgattcaagacagaattactctgagaaggagtccctgtcgttcatgatagacacgatgaaatccaccctcaaagagcagttccagtttgtggaagtcccaggcaatcactgtgtccacatgagcgaaccccagcacgtggccagtatcatcagctccttcttacagtgcacacacatgctcccagcccagctgtagctctgggcctggaactatgaagacctagtgctcccagactcaacactgggactctgagttcctgagccccacaacaaggccagggatggtggggacaggcctcactagtcttgaggcccagcctaggatggtagtcaggggaaggagcgagattccaacttcaacatctgtgacctcaagggggagacagagtctgggttccagggctgctttctcctggctaataataaatatccagccagctggaggaaggaagggcaggctgggcccacctagcctttccctgctgcccaactggatggaaaataaaaggttcttgtattctc

SEQ ID NO: 180043 - DNA, 1656 bp, Homo sapiens
  Payload ID: 15463
  Gene Symbol: SHMT1
  Gene Name: serine hydroxymethyltransferase 1 (soluble)
  Uniprot ID: P34896
  ENST ID: ENST00000354098
  CDS Start-End: 100-1434
cgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatt

SEQ ID NO: 180044 - DNA, 2464 bp, Homo sapiens
  Payload ID: 15463
  Gene Symbol: SHMT1
  Gene Name: serine hydroxymethyltransferase 1 (soluble)
  Uniprot ID: P34896
  ENST ID: ENST00000316694
  CDS Start-End: 136-1587
ggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagta

SEQ ID NO: 180045 - DNA, 2437 bp, Homo sapiens
  Payload ID: 15463
  Gene Symbol: SHMT1
  Gene Name: serine hydroxymethyltransferase 1 (soluble)
  Uniprot ID: P34896
  ENST ID: ENST00000352886
  CDS Start-End: 510-1547
cgggggcggggccaagcccaagcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgccacttggtcataatcatttagatggtggtgtagggcaaagctgttagaaagattgtagcgttttactctccctgggctttcctccgccttgctgcaacagagaggaaatgcccatgtccacagcttgtacacactgccccctcactatcttgttatccagtggcatgccaaaggagaactgaattagcttctgaggcttctgctgtaaatcagaagtgtatgttagtcaagagtaaacaagatgcacccagtatggtgggagggttttgctgtcagtagctcaaagtatggtgtagaaatggcctcctccctccatcctgggaagtcccagtcccatcctggtgtgagaatcaaccaggctttcctgctccacctgagataaccaactccctcccgtaatcaggaagccaaatgtcaccttcccaaagaaattttattttcacgtagctgaagtgcaaaacatagatgaccatttttaataagcacaatcaaatttttaaccacagaatgtctacaagaattatagctttaaaaaatacaaccaatttttatatttcaaaaatatttgaactcaaataaattaatttcttaaaaagtacacttctcatact

SEQ ID NO: 180046 - DNA, 332 bp, Homo sapiens
  Payload ID: 15463
  Gene Symbol: SHMT1
  Gene Name: serine hydroxymethyltransferase 1 (soluble)
  ENST ID: ENST00000583780
  CDS Start-End: 330-332
gcctggcgcgcagagtgcaccttcctgagctcgagcggtccagcgccaagttcggggtttggggttggagcggctggtcacgtggctggcccgcggcggtgcgcggggcgttgggtcagcgggtctgggactggtggcaccggcggcggcgtaggacggaggcgtcgctagggtcttgttctcttggccaggctggagtgctgtgggaaaatctgggctcactgcagcctcaacctccgggactcaagtgatcatcctgcctcagccacccagagtagctgagaatacaggcgtgcgccaccaggctcgggcagcttcgaaccagtgcaatg

SEQ ID NO: 180047 - DNA, 1759 bp, Homo sapiens
  Payload ID: 15463
  Gene Symbol: SHMT1
  Gene Name: serine hydroxymethyltransferase 1 (soluble)
  ENST ID: ENST00000580002
  CDS Start-End: 144-530
aagttcggggtttggggttggagcggctggtcacgtggctggcccgcggcggtgcgcggggcgttgggtcagcgggtctgggactggtggcaccggcggcggcgtaggacggaggcgtcgctaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagaggctcccctgcaaactttgctgtgtacactgccctggtggaaccccatgggcgcatcatgggcctggaccttccggatgggggccacctgacccatgggttcatgacagacaagaagaaaatctctgccacgtccatcttctttgaatctatgccctacaaggtgaacccagatactggctacatcaactatgaccagctggaggagaacgcacgcctcttccacccgaagctgatcatcgcaggaaccagctgctactcccgaaacctggaatatgcccggctacggaagattgcagatgagaacggggcgtatctcatggcggacatggctcacatcagcgggctggtggcggctggcgtggtgccctccccatttgaacactgccatgtggtgaccaccaccactcacaagaccctgcgaggctgccgagctggcatgatcttctacaggaaaggagtgaaaagtgtggatcccaagactggcaaagagattctgtacaacctggagtctcttatcaattctgctgtgttccctggcctgcagggaggtccccacaaccacgccattgctggggttgctgtggcactgaagcaagctatgactctggaatttaaagtttatcaacaccaggtggtggccaactgcagggctctgtctgaggccctgacggagctgggctacaaaatagtcacaggtggttctgacaaccatttgatccttgtggatctccgttccaaaggcacagatggtggaagggctgagaaggtgctagaagcctgttctattgcctgcaacaagaacacctgtccaggtgacagaagcgctctgcggcccagtggactgcggctggggaccccagcactgacgtcccgtggacttttggaaaaagacttccaaaaagtagcccactttattcacagagggatagagctgaccctgcagatccagagcgacactggtgtcagagccaccctgaaagagttcaaggagagactggcaggggataagtaccaggcggccgtgcaggctctccgggaggaggttgagagcttcgcctctctcttccctctgcctggcctgcctgacttctaaaggagcgggcccactctggacccacctggcgccacagaggaagctgcctgccggaggacccccacctgagagatggatgagctgctccaaaggggaactgttgacactcgggccctttgagggggtttcttttggacttttttcatgttttcttcacaaatcaaaatttgtttaagtctcattgttagtaattctgggacaggttattaaaggatttaaatttgaacctggctttctcacagctggacataattctaggaaaataaaatactatgtcgcc

SEQ ID NO: 180048 - DNA, 879 bp, Homo sapiens
  Payload ID: 15463
  Gene Symbol: SHMT1
  Gene Name: serine hydroxymethyltransferase 1 (soluble)
  ENST ID: ENST00000582653
  CDS Start-End: 379-879
aggtgggcggcttcgggtccgagggccgcggcgtcccagagcccggggggtgcttcggcgtcctcgctgtcccccgccgtaccccaccctctgcagccgcaatgacgggaggggagcgcttgggtcgcgcctgggctggggatcgggcggcggccagccgcagcgccccagttccaggcacattcggtatgatggggtggcggcccgtggcctttggcaagaatgcgaaggcttatcggggatgtgagtagtagctctccactgaacacttttctcgttgagcattttcgatttaaacaatcctagctccttcacaacaaagctgcaagtcaagtgctactgtttcccccattttacaggcagcttcgaaccagtgcaatgacgatgccagtcaacggggcccacaaggatgctgacctgtggtcctcacatgacaagatgctggcacaacccctcaaagacagtgatgttgaggtttacaacatcattaagaaggagagtaaccggcagagggttggattggagctgattgcctcggagaatttcgccagccgagcagttttggaggccctaggctcttgcttaaataacaaatactctgaggggtacccgggccagagatactatggcgggactgagtttattgatgaactggagaccctctgtcagaagcgagccctgcaggcctataagctggacccacagtgctggggggtcaacgtccagccctactcaggctcccctgcaaactttgctgtgtacactgccctggtggaaccccatgggcgcatcatgggcctggaccttccggatgggggccacctgacccatgggttcatgacagacaagaagaaaatctctgccacgtccatcttcttt

SEQ ID NO: 180049 - DNA, 378 bp, Homo sapiens
  Payload ID: 15463
  Gene Symbol: SHMT1
  Gene Name: serine hydroxymethyltransferase 1 (soluble)
  ENST ID: ENST00000618902
  CDS Start-End: 1-378
atgagatatttgctccaagttgcacagctggtttggttgactgtagattccagaggcattggtggaacacttgatcatgctggcttcagcatctgcattttcactgtcccacccctaagcttctttggcctctgtgaagcacagactttcggtctgagtggatctaagtctcctgctcttcacagatactatggcgggactgagtttattgatgaactggagaccctctgtcagaagcgagccctgcaggcctataagctggacccacagtgctggggggtcaacgtccctactcaggtgcttgtctcatccatatggcctggtgcagcctcttcatgtgcatcccccagggccgacatgcaccaagaagagtcctaa

SEQ ID NO: 180050 - DNA, 2537 bp, Homo sapiens
  Payload ID: 15464
  Gene Symbol: SHMT2
  Gene Name: serine hydroxymethyltransferase 2 (mitochondrial)
  Uniprot ID: P34897
  ENST ID: ENST00000328923
  CDS Start-End: 453-1967
acggtgctttccagtgttccatagctctttatcttgtgtgggggtctagatctcctggagtctaataatgctagctagatattcagtaggcaccctataaacgtttgtcttgacaacaagcagagagaaaaccctgaaaagcttcaagatagtaaggagagggggcggcactggacctctgtttttgttttttgtttttttccccccaggcaagggcctctaaccctggggctacagacgggaatcataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttg

SEQ ID NO: 180051 - DNA, 2006 bp, Homo sapiens
  Payload ID: 15464
  Gene Symbol: SHMT2
  Gene Name: serine hydroxymethyltransferase 2 (mitochondrial)
  Uniprot ID: P34897
  ENST ID: ENST00000414700
  CDS Start-End: 190-1641
gcggacccggtgctggcaaatgagcggagttttcggcctggtctcacaagctgagcctttccggccagctctgagccctgcagatgatgcaaccgagcttcactgcttgcatcaggcaggggtcccggcggcagtgagggctggaaggaggtggaacggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 180052 - DNA, 2121 bp, Homo sapiens
  Payload ID: 15464
  Gene Symbol: SHMT2
  Gene Name: serine hydroxymethyltransferase 2 (mitochondrial)
  Uniprot ID: P34897
  ENST ID: ENST00000449049
  CDS Start-End: 332-1783
attgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctg

SEQ ID NO: 180053 - DNA, 542 bp, Homo sapiens
  Payload ID: 15464
  Gene Symbol: SHMT2
  Gene Name: serine hydroxymethyltransferase 2 (mitochondrial)
  ENST ID: ENST00000557703
  CDS Start-End: 117-542
ttttcggcctggtctcacaagctgagcctttccggccagctctgagccctgcagatgatgcaaccgagcttcactgcttgcatcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatgggg

SEQ ID NO: 180054 - DNA, 1369 bp, Homo sapiens
  Payload ID: 15464
  Gene Symbol: SHMT2
  Gene Name: serine hydroxymethyltransferase 2 (mitochondrial)
  ENST ID: ENST00000557529
  CDS Start-End: 1-793
tggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactggtgagtgagcaagaaggagccccgggccagccagttcccactcactgtctgctccctcccccagctgatctcactgccttccctagagctctgaccacttgtttcctcaccctctctctctagccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctcct

SEQ ID NO: 180055 - DNA, 576 bp, Homo sapiens
  Payload ID: 15464
  Gene Symbol: SHMT2
  Gene Name: serine hydroxymethyltransferase 2 (mitochondrial)
  ENST ID: ENST00000557269
  CDS Start-End: 245-403
agagttggtggctggacctcctgcgacttccgagttgcgatgctgtacttctctttgttttgggcggctcggatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaagg

SEQ ID NO: 180056 - DNA, 1904 bp, Homo sapiens
  Payload ID: 15464
  Gene Symbol: SHMT2
  Gene Name: serine hydroxymethyltransferase 2 (mitochondrial)
  ENST ID: ENST00000557433
  CDS Start-End: 21-536
cctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccagtgatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 180057 - DNA, 579 bp, Homo sapiens
  Payload ID: 15464
  Gene Symbol: SHMT2
  Gene Name: serine hydroxymethyltransferase 2 (mitochondrial)
  ENST ID: ENST00000554310
  CDS Start-End: 100-579
agatgatgcaaccgagcttcactgcttgcatcaggcaggggtcccggcggcagtgagggctggaaggagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaag

SEQ ID NO: 180058 - DNA, 1659 bp, Homo sapiens
  Payload ID: 15464
  Gene Symbol: SHMT2
  Gene Name: serine hydroxymethyltransferase 2 (mitochondrial)
  ENST ID: ENST00000557348
  CDS Start-End: 173-370
aaatgagcggagttttcggcctggtctcacaagctgagcctttccggccagctctgagccctgcagatgatgcaaccgagcttcactgcttgcatcaggcaggggtcccggcggcagtgagggctggaaggaggtggaacggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcactta

SEQ ID NO: 180059 - DNA, 964 bp, Homo sapiens
  Payload ID: 15464
  Gene Symbol: SHMT2
  Gene Name: serine hydroxymethyltransferase 2 (mitochondrial)
  ENST ID: ENST00000555634
  CDS Start-End: 262-964
gcttgctgccctagaccagagttggtggctggacctcctgcgacttccgagttgcgatgctgtacttctctttgttttgggcggctcggatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcggg

SEQ ID NO: 180060 - DNA, 2215 bp, Homo sapiens
  Payload ID: 15464
  Gene Symbol: SHMT2
  Gene Name: serine hydroxymethyltransferase 2 (mitochondrial)
  ENST ID: ENST00000556825
  CDS Start-End: 207-467
ataaagaaaaaagcggtgagtgggcgaactacaattcccaaaaggccacaaaggggccaccactacgcatgcgtagatccctcccgttagctttggcgcctcagcgagctcttctcgcgcatgcgttctccgaacggtcttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 180061 - DNA, 2152 bp, Homo sapiens
  Payload ID: 15464
  Gene Symbol: SHMT2
  Gene Name: serine hydroxymethyltransferase 2 (mitochondrial)
  ENST ID: ENST00000553837
  CDS Start-End: 308-886
gcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 180062 - DNA, 572 bp, Homo sapiens
  Payload ID: 15464
  Gene Symbol: SHMT2
  Gene Name: serine hydroxymethyltransferase 2 (mitochondrial)
  ENST ID: ENST00000556737
  CDS Start-End: 131-572
aactggcagcttggtgtggccttagaagcatgagtgagggtggccgggagacgatttgtctggactgttgtgatttcaccctgacttttcctgccttcagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatg

SEQ ID NO: 180063 - DNA, 895 bp, Homo sapiens
  Payload ID: 15464
  Gene Symbol: SHMT2
  Gene Name: serine hydroxymethyltransferase 2 (mitochondrial)
  ENST ID: ENST00000555563
  CDS Start-End: 31-291
ggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccggga

SEQ ID NO: 180064 - DNA, 2311 bp, Homo sapiens
  Payload ID: 15464
  Gene Symbol: SHMT2
  Gene Name: serine hydroxymethyltransferase 2 (mitochondrial)
  ENST ID: ENST00000555774
  CDS Start-End: 338-535
attgctctacaatctgtggcctcagcccttgccaactctgcctcttcccccgctgactggggtatcagtttatggtgccctgcaggaagaccctcttgttcctgtgggtgggaaggttctggaatctcagttgccctctctggagttggggagacataggcttttggaggacaagctttgcagagtggttcatggagtgaggtggtgggagatttctgaggtgcggtgcggtgaatggagcaaatcagaaccaccccttggacgttgatctcaagcttggctccagaactggcttttgaaggtggagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctgggccaaacagtgatttgtctccctcaatgtgtacaccgctccgctcccaccaccgctaccacaaggacccccggggctgcagcctcctctttctgtctctgatcagagccgacaccagacgtgattagcaggcgcagcaaattcaatttgttaaatgaaattgtattttgccca

SEQ ID NO: 180065 - DNA, 600 bp, Homo sapiens
  Payload ID: 15464
  Gene Symbol: SHMT2
  Gene Name: serine hydroxymethyltransferase 2 (mitochondrial)
  ENST ID: ENST00000555773
  CDS Start-End: 152-600
acctgcattgctctacaatctgtggcctcagcccttgccaactctgcctcttcccccgctgactggggtatcagtttatggtgccctgcaggaagaccctcttgttcctgtgggtgggaagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggcca

SEQ ID NO: 180066 - DNA, 768 bp, Homo sapiens
  Payload ID: 15464
  Gene Symbol: SHMT2
  Gene Name: serine hydroxymethyltransferase 2 (mitochondrial)
  ENST ID: ENST00000556689
  CDS Start-End: 56-768
cttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacgtgtgtgatgaagtcaaagcacacctgctggcagacatggcccacatcagtggcctggtggctgccaaggtgattccctcgcctttcaagcacgcggacatcgtcaccaccactactca

SEQ ID NO: 180067 - DNA, 569 bp, Homo sapiens
  Payload ID: 15464
  Gene Symbol: SHMT2
  Gene Name: serine hydroxymethyltransferase 2 (mitochondrial)
  ENST ID: ENST00000557427
  CDS Start-End: 93-569
actctcgggcagatccccacccccaccactcccacacagctcttcctcacggactgctaaagcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtc

SEQ ID NO: 180068 - DNA, 562 bp, Homo sapiens
  Payload ID: 15464
  Gene Symbol: SHMT2
  Gene Name: serine hydroxymethyltransferase 2 (mitochondrial)
  ENST ID: ENST00000553529
  CDS Start-End: 121-562
agatgatgcaaccgagcttcactgcttgcatcaggcaggggtcccggcggcagtgagggctggaaggaggtggaacgggtagggggctaacctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatg

SEQ ID NO: 180069 - DNA, 879 bp, Homo sapiens
  Payload ID: 15464
  Gene Symbol: SHMT2
  Gene Name: serine hydroxymethyltransferase 2 (mitochondrial)
  ENST ID: ENST00000554604
  CDS Start-End: 100-678
actctgcctcttcccccgctgactggggtatcagtttatggtgccctgcaggaagaccctcttgttcctcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcgga

SEQ ID NO: 180070 - DNA, 1918 bp, Homo sapiens
  Payload ID: 15464
  Gene Symbol: SHMT2
  Gene Name: serine hydroxymethyltransferase 2 (mitochondrial)
  Uniprot ID: P34897
  ENST ID: ENST00000557487
  CDS Start-End: 69-1553
cttcttccgacagcttgctgccctagaccagagttggtggctggacctcctgcgacttccgagttgcgatgctgtacttctctttgttttgggcggctcggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgc

SEQ ID NO: 180071 - DNA, 1885 bp, Homo sapiens
  Payload ID: 15464
  Gene Symbol: SHMT2
  Gene Name: serine hydroxymethyltransferase 2 (mitochondrial)
  ENST ID: ENST00000555116
  CDS Start-End: 84-281
acaatctgtggcctcagcccttgccaactctgcctcttcccccgctgactgggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaacggctttagctgtttgtgtgtctgtccagcccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggtaacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggtggggttcccctggg

SEQ ID NO: 180072 - DNA, 780 bp, Homo sapiens
  Payload ID: 15464
  Gene Symbol: SHMT2
  Gene Name: serine hydroxymethyltransferase 2 (mitochondrial)
  ENST ID: ENST00000554975
  CDS Start-End: 134-780
attgctctacaatctgtggcctcagcccttgccaactctgcctcttcccccgctgactggggtatcagtttatggtgccctgcaggaagaccctcttgttcctcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcat

SEQ ID NO: 180073 - DNA, 1765 bp, Homo sapiens
  Payload ID: 15464
  Gene Symbol: SHMT2
  Gene Name: serine hydroxymethyltransferase 2 (mitochondrial)
  Uniprot ID: P34897
  ENST ID: ENST00000553474
  CDS Start-End: 124-1575
acggactgctaaaggtctcccctcccacctgcattgctctacaatctgtggcctcagcccttgccaactctgcctcttcccccgctgactgggcctctgcagagatgtgggcagctggtcaggatggccattcgggctcagcacagcaacgcagcccagactcagactggggaagcaaacaggggctggacaggccaggagagcctgtcggacagtgatcctgagatgtgggagttgctgcagagggagaaggacaggcagtgtcgtggcctggagctcattgcctcagagaacttctgcagccgagctgcgctggaggccctggggtcctgtctgaacaacaagtactcggagggttatcctggcaagagatactatgggggagcagaggtggtggatgaaattgagctgctgtgccagcgccgggccttggaagcctttgacctggatcctgcacagtggggagtcaatgtccagccctactccgggtccccagccaacctggccgtctacacagcccttctgcaacctcacgaccggatcatggggctggacctgcccgatgggggccatctcacccacggctacatgtctgacgtcaagcggatatcagccacgtccatcttcttcgagtctatgccctataagctcaaccccaaaactggcctcattgactacaaccagctggcactgactgctcgacttttccggccacggctcatcatagctggcaccagcgcctatgctcgcctcattgactacgcccgcatgagagaggtgtgtgatgaagtcaaagcacacctgctggcagacatggcccacatcagtggcctggtggctgccaaggtgattccctcgcctttcaagcacgcggacatcgtcaccaccactactcacaagactcttcgaggggccaggtcagggctcatcttctaccggaaaggggtgaaggctgtggaccccaagactggccgggagatcccttacacatttgaggaccgaatcaactttgccgtgttcccatccctgcaggggggcccccacaatcatgccattgctgcagtagctgtggccctaaagcaggcctgcacccccatgttccgggagtactccctgcaggttctgaagaatgctcgggccatggcagatgccctgctagagcgaggctactcactggtatcaggtggtactgacaaccacctggtgctggtggacctgcggcccaagggcctggatggagctcgggctgagcgggtgctagagcttgtatccatcactgccaacaagaacacctgtcctggagaccgaagtgccatcacaccgggcggcctgcggcttggggccccagccttaacttctcgacagttccgtgaggatgacttccggagagttgtggactttatagatgaaggggtcaacattggcttagaggtgaagagcaagactgccaagctccaggatttcaaatccttcctgcttaaggactcagaaacaagtcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagccaggtatagtctcccttcccagaatttgtaactgagaagatcttttctttttcctttttttggta

SEQ ID NO: 180074 - DNA, 3137 bp, Homo sapiens
  Payload ID: 15465
  Gene Symbol: SERINC1
  Gene Name: serine incorporator 1
  Uniprot ID: Q9NRX5
  ENST ID: ENST00000339697
  CDS Start-End: 86-1447
tcgcagatagtaaataatctcggaaaggcgagaaagaagctgtctccatcttgtctgtatccgctgctcttgtgacgttgtggagatggggagcgtcctggggctgtgctccatggcgagctggataccatgtttgtgtggaagtgccccgtgtttgctatgccgatgctgtcctagtggaaacaactccactgtaactagattgatctatgcacttttcttgcttgttggagtatgtgtagcttgtgtaatgttgataccaggaatggaagaacaactgaataagattcctggattttgtgagaatgagaaaggtgttgtcccttgtaacattttggttggctataaagctgtatatcgtttgtgctttggtttggctatgttctatcttcttctctctttactaatgatcaaagtgaagagtagcagtgatcctagagctgcagtgcacaatggattttggttctttaaatttgctgcagcaattgcaattattattggggcattcttcattccagaaggaacttttacaactgtgtggttttatgtaggcatggcaggtgccttttgtttcatcctcatacaactagtcttacttattgattttgcacattcatggaatgaatcgtgggttgaaaaaatggaagaagggaactcgagatgttggtatgcagccttgttatcagctacagctctgaattatctgctgtctttagttgctatcgtcctgttctttgtctactacactcatccagccagttgttcagaaaacaaggcgttcatcagtgtcaacatgctcctctgcgttggtgcttctgtaatgtctatactgccaaaaatccaagaatcacaaccaagatctggtttgttacagtcttcagtaattacagtctacacaatgtatttgacatggtcagctatgaccaatgaaccagaaacaaattgcaacccaagtctactaagcataattggctacaatacaacaagcactgtcccaaaggaagggcagtcagtccagtggtggcatgctcaaggaattataggactaattctctttttgttgtgtgtattttattccagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatgaaccctctcgtgagatgaaaagtcagtggacagctgtctgggtgaaaatctcttccagttggattggcatcgtgctgtatgtttggacactcgtggcaccacttgttcttacaaatcgtgattttgactgagtgagacttctagcatgaaagtcccactttgattattgcttatttgaaaacagtattcccaacttttgtaaagttgtgtatgtttttgcttcccatgtaacttctccagtgttctggcatgaattagattttactgcttgtcattttgttattttcttaccaagtgcattgatatgtgaagtagaatgaattgcagaggaaagttttatgaatatggtgatgagttagtaaaagtggccattattgggcttattctctgctctatagttgtgaaatgaagagtaaaaacaaatttgtttgactattttaaaattatattagaccttaagctgttttagcaagcattaaagcaaatgtatggctgccttttgaaatatttgatgtgttgcctggcaggatactgcaaagaacatggtttattttaaaatttataaacaagtcacttaaatgccagttgtctgaaaaatcttataaggttttacccttgatacggaatttacacaggtagggagtgtttagtggacaatagtgtaggttatggatggaggtgtcggtactaaattgaataacgagtaaataatcttacttgggtagagatggcctttgccaacaaagtgaactgttttggttgttttaaactcatgaagtatgggttcagtggaaatgtttggaactctgaaggatttagacaaggttttgaaaaggataatcatgggttagaaggaagtgtttgaaagtcactttgaaagttagttttgggccagcacggtagctcacccttgtaatcccagcactttgggaggctgaggtgggtagattacttgagcccaggaattcaagaccagcctgggcaacatggtgaaaccctgtttctataaaaaataatctgggctttgtagcatatgcctgtggtcccagctactgaggaggctgaggtgggaggattgcttgagcccaggaggcagaggttgcagtgagccaaggtcacgtcactgcactctagcctgggcaacagagtaagacaaaaaaatatatatatattgaaaatcaaaggaggcaaaattttgacagggaaggaagtaactgcaaaacactaggctttagtaggtacttatataaaatctagtccagttctctcatttaaaaaaatgaagacactgaaatacagacttaaatagctcagatagctaattaggaaatttcaagttggccaataatagcattctctctgacatttaaaaataatttctattcaaaatacatgcataattgattttacacctcattactggtggataatttatgtgatgtggattgctggtgtccagcatgacccataaacaggtcagaagaatgatggaatgttttagaataaactcctgcttatagtatactacacagttcaaaagatgtttaaaatgcttttgtatttactgccatgtaattgaaatatatagattattgtaacctttcaacctgaaaatcaagcagtatgagagtttagttatttgtatgtgtcactagtgtctaatgaagcttttaaaatctacaatttcttctttaaaaatatttattaatgtgaatggaatataacaattcagcttaattccccaaccttattctgtgtgtagacattgtattccacaattttgaatggctgtgttttacctctaaataaatgaattcagag

SEQ ID NO: 180075 - DNA, 1997 bp, Homo sapiens
  Payload ID: 15466
  Gene Symbol: SERINC2
  Gene Name: serine incorporator 2
  Uniprot ID: Q96SA4
  ENST ID: ENST00000373709
  CDS Start-End: 151-1518
cgagcgccgccggaaagcgtcgagcggcttcggtaggtggggcggggccggggcggggccggggccggggaggggccaggcccggcacccggatcccgaggtccgcgccccgcgcccggcgccgggcgcccgaagccgggagccgccgccatgggggcctgcctgggagcctgctccctgctcagctgcgcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacca

SEQ ID NO: 180076 - DNA, 2146 bp, Homo sapiens
  Payload ID: 15466
  Gene Symbol: SERINC2
  Gene Name: serine incorporator 2
  Uniprot ID: Q96SA4
  ENST ID: ENST00000373710
  CDS Start-End: 274-1668
tactttagcctttgctctgaaatcccatgcacgctttgtgaggaaggacagccttggttggggggtgtttatggggagagcagagtggatggtgcgtatgtgaatacctctccccagatgctcccccaatcccaagctctcattatcttatatgcatattcataagggatggccctgctctgtaaatgggtcagaagcaggaaatagaggccagtacagacagcgaagcccaagggataggagggctcaaagccggcacacatctgagtcctcatggacgggaggatgatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtacc

SEQ ID NO: 180077 - DNA, 2062 bp, Homo sapiens
  Payload ID: 15466
  Gene Symbol: SERINC2
  Gene Name: serine incorporator 2
  Uniprot ID: Q96SA4
  ENST ID: ENST00000536384
  CDS Start-End: 202-1581
gtatttgtctggttcctgtctgtgtccgtcgttcgtccgactgtctttgtccgtctgctgtcttctgtccgtctgcccgtccgcccgtccgtccctcagtctctctgcggtccctttaccgtcctcagtctggctcgcgctgcctctcaggcacttccccagctcgccccggatcatctgggccccagcgcggagactgggatgggagcggagggagccccggactttcttagctgccctcgagtgaggcgggcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtaccatg

SEQ ID NO: 180078 - DNA, 2072 bp, Homo sapiens
  Payload ID: 15466
  Gene Symbol: SERINC2
  Gene Name: serine incorporator 2
  Uniprot ID: Q96SA4
  ENST ID: ENST00000536859
  CDS Start-End: 212-1591
agtatcacatagctgctgactgtgactgtgcttttgggggtgcaagagacagagctactctggccccatgcaggaggttcaaatctgggagtaaaggctgatgggctggccaggacaccaagaaatgaagctctttatccatgtcctcacttcatctcctcagtagtcccctcagatagctggggtaaaaaaacttatctttattttacagatgagaagcatgaggctgagagaggaggagtcacccggacccagccacacagcgtcctgcctctgcggctctgccccctgcatcctgtgcagctgctgccccgccagccgcaactccaccgtgagccgcctcatcttcacgttcttcctcttcctgggggtgctggtgtccatcattatgctgagcccgggcgtggagagtcagctctacaagctgccctgggtgtgtgaggagggggccgggatccccaccgtcctgcagggccacatcgactgtggctccctgcttggctaccgcgctgtctaccgcatgtgcttcgccacggcggccttcttcttctttttcaccctgctcatgctctgcgtgagcagcagccgggacccccgggctgccatccagaatgggttttggttctttaagttcctgatcctggtgggcctcaccgtgggtgccttctacattcctgacggctccttcaccaacatctggttctacttcggcgtcgtgggctccttcctcttcatcctcatccagctggtgctgctcatcgactttgcgcactcctggaaccagcggtggctgggcaaggccgaggagtgcgattcccgtgcctggtacgcaggcctcttcttcttcactctcctcttctacttgctgtcgatcgcggccgtggcgctgatgttcatgtactacactgagcccagcggctgccacgagggcaaggtcttcatcagcctcaacctcaccttctgtgtctgcgtgtccatcgctgctgtcctgcccaaggtccaggacgcccagcccaactcgggtctgctgcaggcctcggtcatcaccctctacaccatgtttgtcacctggtcagccctatccagtatccctgaacagaaatgcaacccccatttgccaacccagctgggcaacgagacagttgtggcaggccccgagggctatgagacccagtggtgggatgccccgagcattgtgggcctcatcatcttcctcctgtgcaccctcttcatcagtctgcgctcctcagaccaccggcaggtgaacagcctgatgcagaccgaggagtgcccacctatgctagacgccacacagcagcagcagcaggtggcagcctgtgagggccgggcctttgacaacgagcaggacggcgtcacctacagctactccttcttccacttctgcctggtgctggcctcactgcacgtcatgatgacgctcaccaactggtacaagcccggtgagacccggaagatgatcagcacgtggaccgccgtgtgggtgaagatctgtgccagctgggcagggctgctcctctacctgtggaccctggtagccccactcctcctgcgcaaccgcgacttcagctgaggcagcctcacagcctgccatctggtgcctcctgccacctggtgcctctcggctcagtgacagccaacctgccccctccccacaccaatcagccaggctgagcccccacccctgccccagctccaggacctgcccctgagccgggccttctagtcgtagtgccttcagggtccgaggagcatcaggctcctgcagagccccatccccccgccacacccacacggtggagctgcctcttccttcccctcctccctgttgcccatactcagcatctcggatgaaagggctcccttgtcctcaggctccacgggagcggggctgctggagagagcggggaactcccaccacagtggggcatccggcactgaagccctggtgttcctggtcacgtcccccaggggaccctgcccacttcctggacttcgtgccttactgagtctctaagactttttctaataaacaagccagtgcgtgtaccatg

SEQ ID NO: 180079 - DNA, 1726 bp, Homo sapiens
  Payload ID: 15467
  Gene Symbol: SERINC3
  Gene Name: serine incorporator 3
  Uniprot ID: Q13530
  ENST ID: ENST00000255175
  CDS Start-End: 135-1556
catccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatcc

SEQ ID NO: 180080 - DNA, 4445 bp, Homo sapiens
  Payload ID: 15467
  Gene Symbol: SERINC3
  Gene Name: serine incorporator 3
  Uniprot ID: Q13530
  ENST ID: ENST00000342374
  CDS Start-End: 159-1580
ggtgggcggggccacgccgtgacgcatccgtgcgtctgtggaaggctgcgtttccggcctgagaaaccgtcatgtttctggggagtcacctcagctggcagttaccaccgtgttagaaagcagcctcaggaccggccacctccatcactggcgtcaccatgggggctgtgctgggtgtcttctccctcgccagctgggttccatgcctctgcagcggtgcctcatgtttgctgtgtagttgctgtcctaacagtaagaattccacggtgactcgcctcatttatgctttcattctcctcctgagcactgtcgtatcctatatcatgcagagaaaagagatggaaacttacttgaagaagattcctggattttgtgaagggggatttaaaatccatgaggctgatataaatgcagataaagattgtgatgtgctggttggttataaagctgtgtatcggatcagctttgccatggccatctttttctttgtcttttctctgctcatgttcaaagtaaaaacaagtaaagatctccgagcggcagtacacaatgggttttggttcttcaaaattgctgcccttattggaatcatggttggctctttctacatccctgggggctatttcagctcagtctggtttgttgttggcatgataggggccgccctcttcatcctcattcagctggtgctgctggtagattttgctcattcttggaatgaatcatgggtaaatcgaatggaagaaggaaacccaaggttgtggtatgctgctttactgtctttcacaagcgccttttatatcctgtcaatcatctgtgtcgggctgctctatacatattacaccaaaccagatggctgcacagaaaacaagttcttcatcagtattaacctgatcctttgcgttgtggcttctattatatcgatccacccaaaaattcaggaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggtctccttcaccgaaaacccatataccttttaagtttgtttcaactaaaatattaagtgaatgctttgcaagtttgactgtatgcaggtttatatcagaaggtgagattgaataatgcttgatgcagaatcgaaacttctcatttatctgtatattatgtttacttctaaggatatagcacaaagggaacattttttgtttaaagtgaactacagctgtgctgtgaagagagttctttataaagcctgtaggttcttttaactttggtttaaaatgtaagataggaaaatgttggatatttgaggccatgcttaatatatttatattgcagtatcctttaaaagcaaaaaaaaaaaaatgcatttatattacagttttcctctatgaaagtccttacttatatgatacaagcactgtgttttgtgcttaaactcttcagcggggtagcatcaaagttcttggggaaggatcgtatatgtgggtcccttccctagaagaatggttgctgatatggctactgcttctacatcttgagttttttaatttactttttttacactgtagcattgagactgcttgattcaagtctggtgctttgccagatgtattaatttccataaatgctttgtgagtttggttaaaatgaagattcacttgggaaaacactgcagctttagtctgtgttactatcttgttatgagtatgtaaaagtaaaatgcatgtgaatttatcatatttgcactatgaaggtatttggttaaaatacaaagacttttaagattttaaggccctttcttccaacagcttttatagttagcagccattctttattttctggatagccaggttttatcacgcttctagtcaggatgctcctattccttctaaaaattacggtctgactagtgagcaaagtcttgaatttattcaaaagtcctaaataccttctctaggtaagacacttggtagatgagagacggaaggcattgtcaagaaccattttcatgagaggtggtgtgcaaaaaggtagaataaaagagttctttcaacaaagatttactgtctattctgtactagaccctgtaggttttggggtacagtgttaaacatgatagaggctctgccgtcttggactttaatagcttagagaagagagcaaatgagctgacaggtggttataatgtgaattagtgctgtggtttaggaattggagagaactcaaaggagaggtatttggtgtaatggtaggctttctggagaaaatgatatttaagccaagaactcttagaagttagctaagagagagatgggaaaatgagacgacattgctggagtagataaaactgcatgttaaaggcaggaagatggggaaaaaaagttcagtaaagctggaatggggaaatgtagtcagggactgaattttaaagggctttatcaacctcagtaaagagtttggaccttatgttgagggtggctgaaaacatattcatagtgtcatgaacaaattttatcttcagtcacttgggctgatatatagagaatggatttagagagatgagaccaggtgcagtccatatgagatgtgaaatagagaagtggaatcgtagggacggggagaaattgacaggtgagggctacttagcaattagaatttttttttttcaattttaatttttttttttgagacggagtcttgctctgtcgcccaggctggagtgcaatggtgcgatctccgctcactgcaggctccgcctcccgggttcacgccattctcccgcctcagcctccctagtagctgggactacaggcacccaccaccacgcctggctaattttttttgtatttttagtagagacagggtttcaccatgttagccaggatggtctcgatctcctgacctcgtgatccacctgccgcggcctcccaaagttctaggattactggcatgagccaccgtgcctggccagcaattagaattttaacactggcagttatgaataatatgaaggagaggtagatttctgagtgattctggtttaaccagctgggtggatggtggttccacgtattcaggtggcaaacaggaaaaacatgtgttcgaagaagaatggaggtaggtggtctcttaagaatggttaagaggcttgggagtcagactgcttgggtttgcatcccagctttgccgttttctggctatcaaacttgtcagctattatttgttgagtacgtactatttgatttatgaccacaggcagctgagcctcagtgttggtgcctagtgtacaagattgttaaagaataaagttattttgcaaagtgtaacccatttttagcactgacatagcactgacagtagctgctgatctcattatgggctaaaataagacaatattcaaaggtcagagatatctagccagaatctgatggaggctggatttcagattttgttacagaattagacagaggaacacagaggggacaggctcagttagggtggaggtgtggggtagggaagcaggacttgatataaattattggaatcattgtcttttaaaccagtggtttatgtcagggtatagcgtttcaagggatttgagggtcagatggggaaatgtagccccttattttgccagtgtgaagcagataccctgcttttctttacagtagcggagtcagcttaagagctttaaaggtcctaaacttcaaaaacattacagtgccccatcctccgccttaatgtaattcaaaatacaaacaatactaaactgtaaaataaatgtaacaaagtccaataaagtttttatttttttctcatgatgataactga

SEQ ID NO: 180081 - DNA, 812 bp, Homo sapiens
  Payload ID: 15467
  Gene Symbol: SERINC3
  Gene Name: serine incorporator 3
  ENST ID: ENST00000411544
  CDS Start-End: 1-639
gaacaccagcctcgctccggcctcttgcagtcctccctcatcaccctctacactatgtacctcacctggtcagccatgtccaatgaacctgatcgttcctgcaatcccaacctgatgagctttattacacgcataactgcaccaaccctggctcctggaaattcaactgctgtggtccctacccctactccaccatcaaagagtgggtctttactggattcagataattttattggactgtttgtctttgttctctgcctcttgtattctagcatccgcacttccactaatagccaagtagacaagctgaccctgtcagggagtgacagcgtcatccttggtgatacaactaccagtggtgccagtgatgaagaagatggacagcctcggcgggctgtggacaacgagaaagagggagtgcagtatagctactccttattccacctcatgctctgcttggcttccttgtacatcatgatgaccctgaccagctggtacagccctgatgcaaagtttcagagcatgaccagcaagtggccagctgtgtgggtcaagatcagctccagctgggtctgcctcctgctttacgtctggacccttgtggctccacttgtcctcaccagtcgggacttcagctgaacctctgagtgccaaggacaccactggaactcacaaaggcacccaactcagtgatgtcctaattactgctggatgactcaagccacaccatgcctatgttctcaggtgaagaagaataatagaaaccacatagatgggtaggtgtaccaagcattaaacagacagtatccaca

SEQ ID NO: 180082 - DNA, 2318 bp, Homo sapiens
  Payload ID: 15468
  Gene Symbol: SERINC4
  Gene Name: serine incorporator 4
  ENST ID: ENST00000299969
  CDS Start-End: 147-1427
gtgttctcttccggacgtctccattctgcccgggaccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactggcagacaggtgcagctcaagactgtagctggttcctggctgtcctgctggccaccctaggattctacagcatggcaggtgtgggagctgtgctcctattccactattatacacacccagctggctgcctgcttaacaagatgctcctcagtctgcacctttgcttctgtggcctcatctccttcctctccatcgctccttgcatccgcctcacaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 180083 - DNA, 2630 bp, Homo sapiens
  Payload ID: 15468
  Gene Symbol: SERINC4
  Gene Name: serine incorporator 4
  Uniprot ID: A6NH21
  ENST ID: ENST00000319327
  CDS Start-End: 236-1792
gagagaacagcctgagtggccgcagtgttgaggccctaaggacaaagctccttcacagggcatttgcatttaccgcaacctggaggtcagtgttctcttccggacgtctccattctgcccgggaccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactggcagacaggtgcagctcaagactgtagctggttcctggctgtcctgctggccaccctaggattctacagcatggcaggtgtgggagctgtgctcctattccactattatacacacccagctggctgcctgcttaacaagatgctcctcagtctgcacctttgcttctgtggcctcatctccttcctctccatcgctccttgcatccgcctcaagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 180084 - DNA, 2116 bp, Homo sapiens
  Payload ID: 15468
  Gene Symbol: SERINC4
  Gene Name: serine incorporator 4
  ENST ID: ENST00000448553
  CDS Start-End: 1-710
agatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactggcagacaggtgcagctcaagactgtagctggttcctggctgtcctgctggccaccctaggattctacagcatggcaggtgtgggagctgtgctcctattccactattatacacacccagctggctgcctgcttaacaagatgctcctcagtctgcacctttgcttctgtggcctcatctccttcctctccatcgctccttgcatccgcctcagtggagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 180085 - DNA, 2335 bp, Homo sapiens
  Payload ID: 15468
  Gene Symbol: SERINC4
  Gene Name: serine incorporator 4
  ENST ID: ENST00000457418
  CDS Start-End: 112-402
ccgggtgctcagccccaacacagtggcagtccaatgggctgaggacagaagcaactgctgctctcatctgccttccatctggtggacctaagcctaatccctgggacaaggatggtgggtgccaaggccggccccagccccggcacctccctgggcctggcacagcagcacagcggaggcagcagtgtcctagtgaaaagtcccttctgtcagcaagtctccacctcgctgccttgcatctgctctactcccaggtgtgctgctgtgggcctgctccttgtgccagctgctgccactctaggtggccctctctcaccgcatccacttgcagccgcctgttctacatcctcctccatgtgggggcctcagcaatctgctgcctcctgctgtcaaggacagtagtggaaagggtgtggggcaagacacacaggatccagatgccctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcttctggctcctcaagctgctgttcctgttaggtctctgtgctattgccttctgcattcctgatgagcatctcttcccagcatggcattacattggcatctgtggaggctttgcattcatcctactgcagttggtgcttattacagcttttgcccattcctggaacaagaactgagcaaccccgctctggcctcctacaagcttctgtcatcagctgctatatcatgtatctgactttctctgcactgtccagccgtcctccagagagagtaatccttcaaggacagaatcacaccctgtgcctgcctggcctgagtaaaatggaaccccaaacaccagatatctctctagcaatgctgagtgctagcatcatgtatgcttgtgtgctttttgcttgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctctactgcatatccggagtacttgtttggttgtcattgtataataaaggcttcttctgtgatgtttcactta

SEQ ID NO: 180086 - DNA, 1523 bp, Homo sapiens
  Payload ID: 15468
  Gene Symbol: SERINC4
  Gene Name: serine incorporator 4
  ENST ID: ENST00000412697
  CDS Start-End: 1-269
cctcggggttgtgtgcccacctgtttggcctctctgactgtccagtgctcagtggctctggggctgtgtaccgagtatgtgcaggaaccgccaccttccacctgctgcaggctgtgttgctggtccacctccactcccccaccagcccgcgggcacagctgcataatagcatggcattacattggcatctgtggaggctttgcattcatcctactgcagttggtgcttattacagcttttgcccattcctggaacaagaactgcaatgaggcctcctacctggctgaggtatttggacccctgtggattgtcaaggtttacagctatgagtttcagaagccctcactgtgtttctgctgccctgaaacagtggaggcagacaaagggcaaaggggtggggctgcgaggccagctgaccaagaaacccctccagctcctccagtccaagtccagcatctttcctacaactattctgccttccacttcgtcttcttccttgcctcactctatgtcatggttacccttaccaactggttcagctatgagggagcagaactggaaaagaccttcatcaagggtagctgggccaccttctgggtcaaggttgcctcatgctgggcctgcgtactcctctatctggggctgttactggcaccactctgttggccccccacccagaaaccccagccccttatcttgaggcgccgccgccaccgcatcatatccccagataacaaatatcctccagtctaagtccttttcacaaactggggttcccctgacattgtactcctagagttggctcaaggggagctgtccagcccagctcaatacctcaaggacacacagggagttatctccgtttgggctgaagtcaatactatgaactggaagaagtggtcaaacacagtctaatgtgctgggcagagtgtctgactcactggagctactgttacatctgcatcccagctcaagagcctaacacccaaatcagcagctcaaagaaccaccgctgatcccagcagacagtgtggcaccagccctttcctggctcttgggctggaagtgggggtggggaaagaccaacagggactgaagactcggctctgcccttggagaaaggaaaataaggagttcagccctgggcacacggatataagaagcccagaaccacagaacaaaccagggcatagaagaaaggagcacagaggctaccccaggttttaatcctgattttgaggtcaagggaagcgggaagacaaaaccaccctcattccatgaggaatgacagaagagaaagtgaacgcttgacagcagctgaccacgggaagtcggtgagcagcaggattttttggccaactttcaagcagacgaacaaactgaggaagaatgaggaaaagaggcataaacacagatcttgcagcattcactcttaggccaactccatcctagagatggtgttcaagggtggggaacaaaaatcacagaaaagaagtctctatggttcttagaggattcctcta

SEQ ID NO: 180087 - DNA, 1343 bp, Homo sapiens
  Payload ID: 15469
  Gene Symbol: SERINC5
  Gene Name: serine incorporator 5
  ENST ID: ENST00000512721
  CDS Start-End: 93-1343
cggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaagagtggcccattt

SEQ ID NO: 180088 - DNA, 1627 bp, Homo sapiens
  Payload ID: 15469
  Gene Symbol: SERINC5
  Gene Name: serine incorporator 5
  Uniprot ID: Q86VE9
  ENST ID: ENST00000512972
  CDS Start-End: 98-1351
agctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaaaactatcaatgctgaagacttaaggcctcttaagaataccctttttgcaagaggggatggaaacatctctggccccaactccgacaggaaagcctggttttagcattgaaaagatgattgaatacagcttgccttttctccagggaagagagacaagatggagtgccagagaggcctacggcaagaagtgcctttcacctcctgccatgattctgaggcctccccagccatgtggaactctgagaaacctgaacggactccatttggctccttcatttgcaagacatcaag

SEQ ID NO: 180089 - DNA, 1441 bp, Homo sapiens
  Payload ID: 15469
  Gene Symbol: SERINC5
  Gene Name: serine incorporator 5
  Uniprot ID: Q86VE9
  ENST ID: ENST00000509193
  CDS Start-End: 98-1360
agctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaaagtgcctttcacctcctgccatgattctgaggcctccccagccatgtggaactctgagaaacctgaacggactccatttggctccttcatttgcaagacatcaag

SEQ ID NO: 180090 - DNA, 6479 bp, Homo sapiens
  Payload ID: 15469
  Gene Symbol: SERINC5
  Gene Name: serine incorporator 5
  Uniprot ID: Q86VE9
  ENST ID: ENST00000507668
  CDS Start-End: 158-1543
gtttttacccaggcctcggcgcctaggcgcttcgccgaggctgatcttcgttcaagtgtgagctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagttctagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaactacgaaagtgccaacatcgagagcttcttcagcgggagctggtccatcttctgggtcaagatggcctcctgctggatatgcgtgctgttgtacctgtgtacgctggtcgctcccctctgctgccccacccgggagttctctgtgtgatgatatcggcggtcccctgggctttgtgggcctacagcctggaaagtgccatcttttgaacagtgtccccggggcagggactggcgccctgtgcctgagtgggtctgaaaaagctttgagagagaaaaaaaaaaatctcctgattagctttttacttttgaaattcaaaaagaaactaccagtttgtcccaaaggaattgaaattttcaaccaaactgatcatggttgaaatatcttacccctaggaactggataccagttatgttgacttccttctgcatgtttttgccaaaacagaatttggggcacagcatcttttcacagggataaaaatatcttgtggggccagtcattctcatcctcggaatagaaaaacatgccaaaatcttgagtccccagcgcctaacagaatccagacccctctcactcacttccgcctcttagagccttgtccccagggggctttgaggacaggactcagcctgcagggcccctggtatttatagggtccaagaggaggcacctgcttttcaactgcaccctcagtgctgcctcttcacggcccctaaacgtttccctttgaggttgtgatgctgggaatcacagacttcactctctgcctgcacccttccccgaggtctcatcttttctgggtcccacatctttgtaataatgtgaaaaagcacaatttgtctgatcaccccccaggtggttccccaccttattatcactacctgatccgagttactgcaataagtacggcgcttatttatggtgttattcacatgattatagaacaagattcatgttttctctgcctaagcaatggagggctatcattcttacttgtttgtgctgttgataatgataatacttttaggaccttaactgaaaagctgcttcgtgttgaagcctgctgcatgcactgctctttcagttgttgaggtcagcccctcagttttttctccaccttgaggcctttgaaactgtaaaagcggaagtcgttttgtgttctggatctgtaacgtgaccataccgttcaggttcatgctggcatccttggagtaggtttgctaatgtgagaatttctgaggtgaggatctcagacacactgaccagaagaagcttgttaggcaatgtgtggaagtggccgaatatacttaaaaagaggtgcgcagaggcaggcggatcacttgaggtcaggagttgcaagaccagcctggctaacatggtgaaaccctgtctctattaaaaatagaaaaattagccgggcatggtagcgtgtgcctgtaatgccagctactcgaaggctgaggcatgagaatcacttgaacccgggaggcggaggttgcagtgagccgagatcacgctgcacaggaatttccaaaatacgtacttgcaaagtaatacagaaacgtgactttcggcagctacccaagatgatgcctattttcagtgttgatgtattcaggcagggaaaaggtttacttggtggaaactcctgttagaatttcattcggggtggaaagaatcttctcgagctctctgtaagtgaggatctaagaataaaaggctcagcctagtcatttttttctgtgccctactgtatgagttgggcagaattgagtgccacctaagctgggcttctgtgtgccaaaatgctggtgggtgaaattagtgaaattctttctattcattcctttgcccttctcccaagaaaacccatggggaaacaaattacaggggatgaattcctttagaactttccctacttagagtgtttgagattcagtttcaaaaggcactccatctgtgtgtgtggtttagagagccttgttttgtaaattccattaaatttccttttttagggcaggagctctgtactcagcagttaaaagattcatctggagtcgcaaaatgaaaagccgtgttctaacctgaggaatcagttaggggacaggagttccgtgggccaggaatgggctcagggagtggggctgcgtgtcacacacagtagctgtgttgcagtggcctagggccttgggggttgtctttaggaaacaccctgaggggaagcaggtaaagagcctgggcagtattgtgactagtttcattgttttcctcctgctgaggtctagcagagcccttgctttgtcctctcggctgggtctggctgccagctggtgtgatttgagaaactgaccttacgcgcagtcaaggtccagctgacaaggccttgtattccttggctggccgtgattggccctttcctctgcagaaagcagcttagggaagcccaagcaagggagtgtggccggtagaaggccctcgtcgcttccttctggagccagcccagccacacaacgttttccagatgcgtgagtctggtttgtgacatcccgttcccttctgccggttggtctgatgcaagaggaagagttacagttgctctgaattttattctcagctgaaaatgttagcacgtgtatctggatgaacaaaacagatgtggatgtatctgaggattgagggactatcaatgcagagttaatgttaatggttattaattgtgatatacaatactcaggtgaggagtcaacattcctggatttaaagaatctacagttttgtgcaattgtgatttgagaaactggaaacattgtgccaatggctttgagttcctataacaacggtgttaatttgattaactcactgatatcttttaaaaataatagacatttgcttcctacacctttttgtacatgacctaaagagtatattcccagaagctgctggtcagacacatttagggatgacagttgaagaggacttttttaaagctgcatgtgaatatttcctctgtgtgatttgtctgatgtagaaaagttttcccctcatttttatgagtaaaaacactaagtgggtggcaggggggtgggggttcttatgggagtgtcataccgcggcatgttacctgactggagactagagactatttccattataagccttcagaaacccaaccacgtctttactgtgtctagctttttaaatactgattggttagttttatttttgcccacagtttcttgggcaaaaaggttcttcattttgtctgaaaaagaaattatttgccagaggtatttggagcctctttgaaggggagatagagtgggggtgggttgtggggagggtggagttattggggttttggggttctgtttccatacaacattgtttatttccgattcctcagaagatcctttattatgaataacctcagtgtaatgttaatttcctgtccccatgtcaaaattgtcaccctaagcctttttttttttttttttttttttttttggagacgggctcactctgtcagccacgctggagtgcagtgacatgatcttgactcatggcaggcttgacctcctgggctcaaggaccacctcccaagtagctgagaccacaggtttgccccatcacacctggccgatttttatttttttgtagagatggggttgtccaggctggtctcaaactcctgagctcaagcaatgtgcccgccttggcttcccaaagtgctgggattataggcgtaaaccactgcacgcagcctaccctctgcctttttaagatgatgtatttatttaatttttgccatcattggtgcttcaccttcctgcgaaggaaattccagagcctgtatttaagctacctaggcttttacactccctttattgcctttccaaatagtatctcatttggtgtactctagtgtcctatacctcttggaaacgaaagagggcccaacctacaactaagaagggacaaaccttgaactaagtaagaccttacacacccagaaagaacactgggccctccttcttcagggacaatgcagtagccacttggcttgtggaatttactgaaggctatttcctgtaacttgctagttaacttagttttgtatttcaggcagaggtgcgctctgtaatgttgggcctttgacttcacagtactggagagctgttcacacagatgtttagacctttctctctctctctcttttcttctttctcaacaactctttcacagaggcagtcattttgaaaggttgaaatatttggcctttaccaaagagctttttttttccttaagcaaaatcctttcagaaagaaacaaatggggaagggcagattaagaatgcatatgtcccaatccacttctataggagtttaatcatattcacatgagtaaaatgatggaagaactctttaaggtaatcctttgggataaaggatcctgggaagttctctcaggtaaagaaagcttacagcagatttgtaatatatgtctggagagctatttataagaaatttaagaggattgttttgttttcctttattaaagatttaagcctttttactttgcaaaaagaaaactacaaaagttttatagatataactttgctaattttttaaacttttctgaaacgattagctgtagccaaattatgtggttacgttttgctacattagaatttgaaaatgcaatatgtgtggtaaatctactgtttgaaatttataatggtctctgatatgattcgaattttggtaacttttgaaagttattttccccctttagtcatggatttctatttgttttttaatgttaatttttctagaaagcatctgaattgactaggcttttcctatataaaaaactcaaaacttgttaactctgtactttaataaaatttaaaattaaaactgtgttgtttttttctcttctgctagatacatatataattaaagtactcaagttagttgttttgcagagatgttgccttcagatgttaatcaggtctctcaagtttcatggagtctatgctgatcctttaattgacaaataaaagatatatatctgtggtgtgcaa

SEQ ID NO: 180091 - DNA, 1573 bp, Homo sapiens
  Payload ID: 15469
  Gene Symbol: SERINC5
  Gene Name: serine incorporator 5
  ENST ID: ENST00000632581
  CDS Start-End: 98-1468
agctgcggctgagcccagcgctcgaggcgcgaggcagccaggagggcccgtgcggcgcggggagccagcgagcgcgccttcggcattggccgccgcgatgtcagctcagtgctgtgcgggccagctggcctgctgctgtgggtctgcaggctgctctctctgctgtgattgctgccccaggattcggcagtccctcagcacccgcttcatgtacgccctctacttcattctggtcgtcgtcctctgctgcatcatgatgtcaacaaccgtggctcacaagatgaaagagcacattcctttttttgaagatatgtgtaaaggcattaaagctggtgacacctgtgagaagctggtgggatattctgccgtgtatagagtctgttttggaatggcttgtttcttctttatcttctgtctactgaccttgaaaatcaacaacagcaaaagttgtagagctcatattcacaatggcttttggttctttaaacttctgctgttgggggccatgtgctcaggagctttcttcattccagatcaggacacctttctgaacgcctggcgctatgtgggagccgtcggaggcttcctcttcattggcatccagctcctcctgctcgtggagtttgcacataagtggaacaagaactggacagcaggcacagccagtaacaagctgtggtacgcctccctggccctggtgacgctcatcatgtattccattgccactggaggcttggttttgatggcagtgttttatacacagaaagacagctgcatggaaaacaaaattctgctgggagtaaatggaggcctgtgcctgcttatatcattggtagccatctcaccctgggtccaaaatcgacagccacactcggggctcttacaatcaggggtcataagctgctatgtcacctacctcaccttctcagctctgtccagcaaacctgcagaagtagatgaacatgggaaaaatgttacaatctgtgtgcctgactttggtcaagacctgtacagagatgaaaacttggtgactatactggggaccagcctcttaatcggatgtatcttgtattcatgtttgacatcaacaacaagatcgagttctgacgctctgcaggggcgatacgcagctcctgaattggagatagctcgctgttgtttttgcttcagtcctggtggagaggacactgaagagcagcagccggggaaggagggaccacgggtcatttatgacgagaagaaaggcaccgtctacatctactcctacttccacttcgtgttcttcctagcttccctgtatgtgatgatgaccgtcaccaactggttcaaatggagtcccactctgttgcccaggctggagtacagtggcatgatcttggctcactgcaacctccacctcccagatgtcaagcgattctcttgcctcagcctcccaagtagctggggttacaggcatgtgccaccatgaagtgcctttcacctcctgccatgattctgaggcctccccagccatgtggaactctgagaaacctgaacggactccatttggctccttcatttgcaagacatcaag

SEQ ID NO: 180092 - DNA, 1894 bp, Homo sapiens
  Payload ID: 15470
  Gene Symbol: SPTLC1
  Gene Name: serine palmitoyltransferase, long chain base subunit 1
  Uniprot ID: O15269
  ENST ID: ENST00000262554
  CDS Start-End: 7-1428
ctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgatgttcatttggatttggaagaccgcctggcaaaatttatgaagacagaagaagccattatatactcatatggatttgccaccatagccagtgctattcctgcttactctaaaagaggggacattgtttttgtagatagagctgcctgctttgctattcagaaaggattacaggcatcccgtagtgacattaagttatttaagcataatgacatggctgacctcgagcgactactaaaagaacaagagatcgaagatcaaaagaatcctcgcaaggctcgtgtaactcggcgtttcattgtagtagaaggattgtatatgaatactggaactatttgtcctcttccagaattggttaagttaaaatacaaatacaaagcaagaatcttcctggaggaaagcctttcatttggagtcctaggagagcatggccgaggagtcactgaacactatggaatcaatattgatgatattgatcttatcagtgccaacatggagaatgcacttgcttctattggaggtttctgctgtggcaggtcttttgtaattgaccatcagcgactttccggccagggatactgcttttcagcttcgttacctcccctgttagctgctgcagcaattgaggccctcaacatcatggaagagaatccaggtatttttgcagtgttgaaggaaaagtgcggacaaattcataaagctttacaaggcatttctggattaaaagtggtgggggagtccctttctccagcctttcacctacaactggaagagagcactgggtctcgcgagcaagatgtcagactgcttcaggaaattgtagatcaatgcatgaacagaagtattgcattaactcaggcgcgctacttggagaaagaagagaagtgtctccctcctcccagcattcgggttgtggtcacggtggaacaaacagaggaagaactggagagagctgcgtccaccatcaaggaggtagcccaggccgtcctgctctaggcagagtcccgggaccatggcctcctgccacacaacacgcagagaggactcaagactcccgctggccatggagtggcctgaaagagagcaagaacatgtggatctttgataggattgttaccaaatggtgtcagtatggaccaattgtgtgaccatgagaaggatgcttattttttttaaaaagaaaacacatctaaaagcccaggaactgatttttttaagaggaaaactaatgacagtgtataactgatgtttaaattgtgcatttagtactatttaaatgttttcttatactagtattttatattcttttgttgtcgtttaaaactggagcttcagtgtctcttccctccctctaatagtaatggttcagtaagcactccttaactccttagtatttcatagaaaaatgactgcaacattaaagctaagaggaacacttcaacatatgtggtacaaatttata

SEQ ID NO: 180093 - DNA, 946 bp, Homo sapiens
  Payload ID: 15470
  Gene Symbol: SPTLC1
  Gene Name: serine palmitoyltransferase, long chain base subunit 1
  Uniprot ID: O15269
  ENST ID: ENST00000337841
  CDS Start-End: 14-445
gaagcggctaactatggcgaccgccacggagcagtgggttctggtggagatggtacaggcgctttacgaggctcctgcttaccatcttattttggaagggattctgatcctctggataatcagacttcttttctctaagacttacaaattacaagaacgatctgatcttacagtcaaggaaaaagaagaactgattgaagagtggcaaccagaacctcttgttcctcctgtcccaaaagaccatcctgctctcaactacaacatcgtttcaggccctccaagccacaaaactgtggtgaatggaaaagaatgtataaacttcgcctcatttaattttcttggattgttggataaccctagggttaaggcagcagctttagcatctctaaagaagtatggcgtggggacttgtggacccagaggattttatggcacatttgaatgaagatgaaggatcattgatttccttgtgtatggataatccgggaacaggccaactaaatatttgatgaatgtatgatttcaaatacagtgaattccctgggagtcatcaaagaagaccggcattttatggttgtttttattaagtgtatattctttgctcctgaaaatgttattaaataattgtttaggccgggcatggtggctcatgcctgtaatcccagcactttcaaaggctgaggcaggcagatcacctgaggtcaggagttcaaaaccagcctggccaacatgctgaaacctcgtctctactaaaaatacaaaaattagctgggcgtggtggtggatacctgtaatcccagctacgtgggaggctgaggtgggagaattgcttcaacctgggaggcagaggttgcagtgagccgagatcatgccactgcactccagcctgggcaacagagcaagactgtctcaaaaataaataaataaataaaattgtttaaatgaa

SEQ ID NO: 180094 - DNA, 8170 bp, Homo sapiens
  Payload ID: 15471
  Gene Symbol: SPTLC2
  Gene Name: serine palmitoyltransferase, long chain base subunit 2
  Uniprot ID: O15270
  ENST ID: ENST00000216484
  CDS Start-End: 195-1883
gcgtggccttggccgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacggggaagtacggaacgggtacgtgaggagcagcgctgcagccgcagccgcagccgccgccggccagatccatcatgttacacaaaatggaggactatataaaagaccgtttaatgaagcttttgaagaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttggtacctctactggacaggccctttgacgagacgacgtatgaagaaacagaagactgagcctttttggtgctccctcagaggaactctccctcacccaggacagcctgtggcctttgtgagccagttccaggaaccacacttctgtggccatctcacgtgaaagacattgcctcagctactgaaggtggccacctccactctaaatgacattttgtaaatagtaaaaaactgcttctaatccttcctttgctaaatctcacctttaaaaacgaaggtgactcactttgctttttcagtccattaaaaaaacattttattttgcaaccattctacttgtgaaatcacgctgaccctagcctgtctctggctaaccacacaggccattcccctctcccagcaccttgcagacttgggcccatcaagagctactgctggccctggctccgcagcctggatacttacctggccctcctccctagggagcaagtgccttccacttacttcccatccaggtctcagaggtctcaaggccaaccttggaatccttatttaaccattcaagtaatcaacggaagttttcaccctttaatcttaagtttagccttttaagaaaaacagtaagcgatgactgctgaaaggctcattgtgtaatctcccaagggtttggtcttattccattttcttctggtcaccagatgatttcttcctttaccatcaaatacttcttcataatggtcacagtctgaggatgtgcgcaaattctggttcttcccaagctctaaccgtaacacgtcccaccccctttttaaagcacttactgttttcagagcacccatatcccaccctggtgagaaggccactctcacatctgagtgttgggtacaaagctgctccgtagagtgatgtgcactcctggtgggtgaggggcaggggcagtggcagtgtgcaaagaattgattactccttgcagagcctgtggcttgcatttcctactgctttctacgtttgaaaattatgacagtctctggctaggtctgggtccagattaggatttaaactgataaaggaaactgttggtaaatcctctgctcagaaagcatttatcatgttcctatttaaggattaggtttattaatttaggcctcttagaagctaacccacttaaatattactcttctgaatgctagttctcttttattcttgatgtcctaagtcaattgaatctggcatctggggctagggtctgcctgtctacatattttttatttttttctgagaaattctgaacacatagatctctttcctaaactgacattttctattttgactgttttcatactataaccaggtaaagggacttctttcagagagctttatactgcctgaccaaagaacaaatctgaaaatcaccattttaaagttattttttcagttgaaccaaagtttaagtgaagaggacttttggcatattatacccaggatcagtttgtctttttgtatccatcaagtattacaggagaaggattgggaacagaatggaaaaacagtgtatgaaagtcatgttacaggccgagtgcggtggctcacacctgtaatcctagcactttgggaggctgaggcaggtggctcacttgaggtcaggaattcaagaccagcctggccaacatggtgaaaccccgtctctactaaaaagacaaaaaattagctgggcgtggtggcgggcacctataatcccacctacttggtaggctgaggcaggagaatcgcttgaacccaggaggcggaggttgcagtgagacgagattgtgccactgcactctagcctgggtgacagagcaaaactgtgtctcaaaaaaaaaagtcatgttacacatttaagtttttgaaattgctccttttatcggtaaagattctcaatccaaattctcctgggtgtgttgtcatcagctgtgatatgtttgtgcacattacgtatagcagaggatgtaagcaatattattgtttgtgaagttttgtttttaatgtcttgagtatgagttatgtttagtcactgtcagcatctgagaactttaataagcccttgagatattccaaagttttattttacttttttaaagaacagaaaaagatgaatgaaagaaccaaggagagatgcagagactatatttagcatgtataggttaaagtaagaaggaggttgtggtaactaaataggagtcctataaaatcaaatacattgtcaaccttttctgcacatctagtttcctaccatagaatcccactggaataccacatagcttttgcactgcagttactatttactaatgtaaacgtagggtttgtaaaagtcacaaacttataagcaatgaacttacctgctagtctttttattttggcttgcatgaagtcactgcaaattcaaatgtcagtaccggcatttaaaatatatctatatcactttgttggtacaaagttatttcaagataagtgtaattttgttacaagtttattttgaagagacaaatctcctgtgatctatgcaggacctctgtactttctaaagaacaaaatgttatgtagacattatacatggttggttgtctcttcttgaaactgtaatgtaaatctagggtccagtcatatcctaggtatcatcatttatccaagtacttggaggaatacaagtatatataaatacagtcattgagaataagtcgatttgaggcatacaagagtagtttcttacacagtttaacacggcctgattcaagactctgataggattcaaacagataccggttaaccatgactaccaaaactgatcatctgagtcgattgatagaggtgtgactagtccttagcactttttctcattcctctttttattcagcattgctgttacctatttcaggtttataagacctctttcagcagatcacatcagaagccaggaaatgcatagctaggagatgtcaaaagcccatatgaggagtggaccaagcagcagtggcggtttctcctcgcatctttttttttttaagctttaacttagcaggggcatggactttatagcactttttcaactttttgctttgctttggataagaaatccttacctttaaaaaaagcttctagtctccataacccccaaagtactgcttatttgtttgaagaatccagccatcgtagtgctttagtcactatcgtaaacattcatgatagggcaaggattttaaaacaggattcttgcttctgtagtcatcaaggtgaacagaagcatcctacacaaccactaagggctctatgtttgtgtcatgcctcttcaaacaccaaggagttgaacatgcttccagtgatttgtctccgtaatgccttcttcctttatttggcctttctttctttctgtaccttcaagttcttgatttttaaaattccaactctagagaaaaccaatatatggtggtgctgggctttgaagatagcatatcagacgccttggttctgtttgtacacttagccttacatttcaggaggaggcttttcattaggggcttaagctagctcctttggcttttaaaaaaaattttttttcaaatttcttcattacctaagggagcctgcatctaaatttctcaactagttcagcctagctgaattttctagtgtgttatacactttgcttccttcttattggtgaaaaccagggggatgagtggcttccatggagagatttcctgatttctcagggaggaaaaaagtgatgacatttaccactacttttatgtttttcccctttttccaaattgataaggatttctggttcctagtgatccgggattgggcaacagtgcagaactgccagtcatgccgtaggccgtgaagaaagaatgtgagtaactgttgttttgcaaggatttgtagggttatgggcagttgttgtttgaagcattgctatgacctaattcccaaggtatctttcctctcttggtgttctaggtaagccaatgagctttaatctctacttgctataaccgtgtgcttagaaaaagaggtgagagtagtggttttccttcaaactgtccacattcatgaagattatgaattgttaggacagccagggcaagatagaccctgtctctacaaaaatttttttctaaattaaccgggcatggtggtgcctgcctgtagtcccacctgtgtgggagaatcacttgagcctgggaggtcaaggctgcagtgagccatgattgcacccctgcactccagcctgggtgacagagtgagaccctggctcaataagagggggaaaaaaaattgttaggagctgggtgcggatgcagcctgcaatcccagctacttgagaggctgaggccggaggattgcttaaacccaagaatttgagcgtagcctgggcaacacagcaagaccccatctaagaaaaaaatgttttttaaatcagcttagcccaaaggggttgtgaatggggaggtataaaaagcaaagattattttttggctactaagccaagaacttacagggattttttttttcagtcccagaacctacagataccctgctacttgcttcacgtggatgctcagtgcccagcagccatcttaatacattaaaccagtttaaaaaataccttccatgtggagaaaaacatgtctttttctcgcctcaactttatccacatgaaatatgtgcccatggctgggcgcagtggctcacctgtaatcccaacactttgggaggctgaagcaggcagattgcttgaggccaggagttcgagaacagtctggccaacatggcgaaacctcatctctactaaaattacaaaaattagccgggcatggtggcacatgcctgtaatcccagctacgtcaggaggctgaggcacaggaattgcttgaacccaagaggcagaggatgcaatgagccaagatcacaccactgcactccagccttggcgacagagggagactctgtctcaaaaaaaaaaaaaaaaggtgtgcccaggcccctagccattgccatgtgcccagccagagagccaaattagagggctggcttccctatcacacagaataaatgctagtgctagccaatgatccctttgcttttaatgtatagaaaatactgttgttccttttgtcatttccagtgacatctgttttctaagcagctcttttctagggaggaaaccaaaggggctaggttaagaccctaatagaaatgttttttctaatctctggtgagtctggaagtgtcacattcacagtccacccttgggagtggcttggtggagctggggacaaggttttgtttactacatagtgcacatgataaatggccttaaactgtgattctttctggtaggataagttataataaactgaccctaaagaatgcaatggcttttaaactgcagttactgtgttcttaatgaagcaatacccaaagctctgttcttttggagcacttgaggggagcttgaatgaaaggtgcagataagagcagtaccttgatcttatgctttctgagtgtcctgccttgttgccatctgcatggatgagtgaatgcttctatgcacgaggagactcaagccaactcagagtctgctttttccaacgctcttcccaggtttcttttgcaaagcttggtcatttggcccaggtcttcctggaaagtggagtacatgtcactgactagggtggcgtggtgtctttacccttaacattaagtcttgttacctcagtgatgtgaagccaatggttggaattataaaaagcatccttgctggttcttcacaggacactggaacccaccctgtcaattcagctagcatgtccacacagtcttgatgatccctctctgtaacaggcagctaacattaagagaagggggaaagagaagaagagagcaatagcttatgggagagctgagatcttacttcgttgacccatatttttcccctgaccaagttacctgtaaactggaatttgcaaggggatgctgtgatgataacccctttctattgctgtaatgttcatataacctgggaaactgagagaaggggatgtgtaaataaaagcttaaacattttagtaatgtgttaaaatgtcactctctcttaccctgtttcccttttttgccagatgatgatttttttatttttattttgtactttactggatgactgtgaagcgatgagtattgggttggggtaggtgtgttgattttgagagtgcatgttaagaactgaaggggaactacttgagatgacttaagaagcatcccatgcaaatatcttgttttgccctaataaaatattcagaaagata

SEQ ID NO: 180095 - DNA, 460 bp, Homo sapiens
  Payload ID: 15471
  Gene Symbol: SPTLC2
  Gene Name: serine palmitoyltransferase, long chain base subunit 2
  ENST ID: ENST00000556607
  CDS Start-End: 1-123
catagtgcagtgtatgccacgtcattgtcacctcctgtagtggagcagatcatcacctccatgaagtgcatcatggggcaggatggcaccagccttggattattttgttttctctcaccgtgactttccaggtaaagagtgtgtacaacagttagctgaaaacaccaggtatttcaggagacgcctgaaagagatgggcttcatcatctatggaaatgaagactctccagtagtgcctttgatgctctacatgcctgccaaaattggcgcctttggacgggagatgctgaagcggaacatcggtgtcgttgtggttggatttcctgccaccccaattattgagtccagagccaggttttgcctgtcagcagctcataccaaagaaatacttgatactgctttaaaggagatagatgaagttggggacctattgcagctgaagtattcccgtcatcggttg

SEQ ID NO: 180096 - DNA, 1518 bp, Homo sapiens
  Payload ID: 15471
  Gene Symbol: SPTLC2
  Gene Name: serine palmitoyltransferase, long chain base subunit 2
  ENST ID: ENST00000554901
  CDS Start-End: 1-1222
agaaacaccaatgctggttgctgtgctcacgtatgtggggtatggcgtactcaccctctttggatatcttcgagatttcttgaggtattggagaattgaaaagtgtcaccatgcaacagaaagagaagaacaaaaggactttgtgtcattgtatcaagattttgaaaacttttatacaaggaatctgtacatgaggataagagacaactggaatcggccaatctgtagtgtgcctggagccagggtggacatcatggagagacagtctcatgattataactggtccttcaagtatacagggaatataataaagggtgttataaacatgggttcctacaactatcttggatttgcacggaatactggatcatgtcaagaagcagccgccaaagtccttgaggagtatggagctggagtgtgcagtactcggcaggaaattggaaacctggacaagcatgaagaactagaggagcttgtagcaaggttcttaggagtagaagctgctatggcgtatggcatgggatttgcaacgaattcaatgaacattcctgctcttgttggcaaaggttgcctgattctgagtgatgaactgaatcatgcatcactggttctgggagccagactgtcaggagcaaccattagaatcttcaaacacaacaatatgcaaagcctagagaagctattgaaagatgccattgtttatggtcagcctcggacacgaaggccctggaagaaaattctcatccttgtggaaggaatatatagcatggagggatctattgttcgtcttcctgaagtgattgccctcaagaagaaatacaaggcatacttgtatctggatgaggctcacagcattggcgccctgggccccacaggccggggtgtggtggagtactttggcctggatcccgaggatgtggatgttatgatgggaacgttcacaaagagttttggtgcttctggaggatatattggaggcaagaaggagctgatagactacctgcgaacacattctcatagtgcagtgtatgccacgtcattgtcacctcctgtagtggagcagatcatcacctccatgaagtgcatcatggggcaggatggcaccagccttggtaatggcatcactattcatgaagttgtccaaacaagaaatacctatcatcgtttctctcctttatcccctgtatttagtcaccagtgcctatggatcatgcttccttaatatctttgaacctgtctacttctccatatctcattgttatttacttgacttagatttctgtccactttcacctggttttaatagccagccagtcataatagtagaggaatcagtcaagcaaaaatgctttggaagaattaaataagcaatgctgaacatcaggaattgtagatatccgtacagagagttccagtaaaattttatgagtccacgaccccttttctaagcagtctggtccatgttggtctcatacctcatatgcaggattcattcattcattaaatatttgtttcata

SEQ ID NO: 180097 - DNA, 6169 bp, Homo sapiens
  Payload ID: 15472
  Gene Symbol: SPTLC3
  Gene Name: serine palmitoyltransferase, long chain base subunit 3
  Uniprot ID: Q9NUV7
  ENST ID: ENST00000399002
  CDS Start-End: 275-1933
ggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatgaatatcccagcattagttggaaagggatgcctcattttaagtgatgagttaaaccacacatcgcttgtgcttggggcccgactctcaggtgcaaccataagaatcttcaaacacaacaacacacaaagcctagagaagctcctgagagatgctgtcatctatggccagcctcgaacccgcagagcttggaaaaagattctcatcctggtggagggtgtctacagcatggaaggttccatcgtgcatctgccccagatcatagctctaaagaagaaatacaaggcttacctctacatagatgaagctcacagtattggggccgtgggcccaaccggccggggtgtcacggagttctttggactagaccctcatgaagttgatgtgctcatgggcacattcaccaaaagttttggagcttcaggaggttacatagctggaaggaaggacctcgtggattatttacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggtgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataaaatgtgtcataaatatgcaaagaaagggagacatactgttcttatcttgaatatgtgcatttaaatgaattgtccaaaatgcataaatgccttgcgttctataaaggaaacaggaggtcaaaaagacagcgagatatctagtccttccacaaggtatggaaagcaataaacatcttcctttctttctggatctgtctgtgatgtttacacacaccttcacatctacacttcaagttttaagcccctagacatgtgtcttcatgagcaggaatgtccactattattactttcatggaggatattgggtctaattcattgtgggaaactacttacctacccagcatggaaggcagggaggaagttagtctcttttcatcaagattcaagagtacaggggcaatttattacactgcaatgtacaaaacaaaaggacctgtttctgttagagagtccatgttgaatatacaggtatgagaacaactgttgatatacaggtataatccaagtagaatgcttccacagtgcattagaaggtgcccaagctccacagggccaataatattagagtatatgtcatatagaataaggttaattaggagggtgattgtgaataatgagatttttaatttttttaagaaaaagctctcaaatgctaggctaataagttcatgattttaattcatgattttaattcatgattaaaattatttgattattgagtcttgataattatatcatcaaccattaccctctacatcaccgccccgaccttagctctaattatatcagagccaaaaatgtgtctttggttagatctgttggaaaagagaattttctataatgttatgcgcactcagcccttctgttcacatttacacacatgcacacacacatacacatatgcatttttcctttacggagtaagcaactatgaaaatctggttggttgagaaataaatggaagatgttcttgaaaatgacctcaggaaagcagaagataaaggttccagatgatatttgtaaggaggctatctctgtataataaggaaatggcatagacttattcctaatctcattatgaaacgatggtgtcatggacgtttaaccatattgcctttcagcatgctttgattttacagagacgacaggctttggaatttactaggaagctggctaaaatccatacccctaggccctacaccagacctttactgaaacataatagttgtagtgcccaggaatctacatttttaaccagccttcctgcgtgattctaatctatgccaaaatttaagaacattattcaaactctaatttgataaaccaattgactctaatagcaggaaccttgttctgattctcttgttcataattaagtgtatatatactggtaaaattaatttattccacagtcaaccttctcttctcattgggacattttgttcccattttccaagtaacttctctttctacaaaaattgatccaatattgaagaaccatctgcgattcatttgggtaaaattatgccttcttcagttttctgtatcattccctataagatgcccatttgctttgaatgtggtatctttcttttctttctttctttttttttttttttttgagacagagttttgttcttcttgttgcccaggctatagtgcaatggcaagatctcggctcattgcaacctccacctcccgggttcaagcgattctcctgcctcagcctcctgaggagctgagtttacaggcatgtgccaccaagcatggctaattttctatttttagtagagacaaggtttttccctgttggtcaggctggtctcgaactcctgaccttaggtgatcctcccacctcggcctcccaaagtgctgggattacaggcgtgagccaccgtgcccggcctgaatgtagtatctttcttctgttttcttttcctgctctttaaaaaacaaccttcaacctctgattatttattccaacaacagctcttcagtagggtaaaagtcttaacagttcttcaaacgaacaatattcttttgtatttttcttcagagatagcaaatgttataaatggcctactctgatttaaaaacctaagttccgatgatgatgaaacattaactcttaaatatacattttgatttatagcaataataacaattgtaacaacagcaattaagaacagcatctggtgaattcttggcaatgtttcctggtctcaaaacagtaagaacaatttgaagtctgttctttagaatgccctactcagctgcataatgtttagaaaattaaagagtctgtattttaaatatttttaggtaattattgcgggacattgtcttatggtgtcctgatgtacgtggggtgtgcatgtgtgtgtgtgtgtgtgtgcatgtgtctttgtgtgtgtgagaaggacagagagaaatgtatgtttcactgaaacatttgaaacgaccaatttcactttattgtgcctgtaaaatgttagttttaaaataaataaaaataatatgaaaataa

SEQ ID NO: 180098 - DNA, 572 bp, Homo sapiens
  Payload ID: 15472
  Gene Symbol: SPTLC3
  Gene Name: serine palmitoyltransferase, long chain base subunit 3
  ENST ID: ENST00000434210
  CDS Start-End: 154-572
ccagcatggacaatctcctttacagtttcggaagcaggtttgttgccatggagttcacattttgacgggagttgagaagtataaagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgattt

SEQ ID NO: 180099 - DNA, 645 bp, Homo sapiens
  Payload ID: 15472
  Gene Symbol: SPTLC3
  Gene Name: serine palmitoyltransferase, long chain base subunit 3
  ENST ID: ENST00000450297
  CDS Start-End: 1-645
aactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggtgaattcacctcatcctggcagaatgccctctgtgtgggaggggtcttgcaagctgactcagtgccacaggggccaccctggtcatggaaaatgggcaggcactcttccctgttggag

SEQ ID NO: 180100 - DNA, 453 bp, Homo sapiens
  Payload ID: 15472
  Gene Symbol: SPTLC3
  Gene Name: serine palmitoyltransferase, long chain base subunit 3
  ENST ID: ENST00000431275
  CDS Start-End: 1-365
tgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggtgatttgctgtgtcatgaagatataacttcaaatgcattctgcaaccttatctttttcttccacaagactacatataagtcactacattttaaaataaaaccttttaagggtaa

SEQ ID NO: 180101 - DNA, 2777 bp, Homo sapiens
  Payload ID: 15473
  Gene Symbol: SPTSSA
  Gene Name: serine palmitoyltransferase, small subunit A
  Uniprot ID: Q969W0
  ENST ID: ENST00000298130
  CDS Start-End: 150-365
gggtctgggcgtgccgcgggtgacggcggggccgggcgggccaatgggcgctgggtggcgggcgggcgggcctggcggccgggggctttaggacgtgagcgggcggccggccggacagactgacgtgtgagctgcatcgcgggaggcgcatggcggggatggcgctggcgcgggcctggaagcagatgtcctggttctactaccagtacctgctggtcacggcgctctacatgctggagccctgggagcggacggtgttcaattccatgctggtttccattgtggggatggcactatacacaggatacgtcttcatgccccagcacatcatggcgatattgcactactttgaaatcgtacaatgaccaagatgcgaccaggatcagaggttccttggggaagacccaccctacgaagttggaatgagaccatcagatgtgataagaaactcttctagatgtcaacataaccaaccttataaagactaaaattcatgagtagaacaggaaaatcatcctgactcatgtgttgtgttctttatttttaattttcaaagaggctcttgtatagcagtttttgtctattttaacattgtagtcatttgtactttgatatcagtattttcttaacctttgtgactgtttcaatattacccccgtgaaagcttttcttaatgtaactttgagtacattttaattgccttctatttttaaaactcaaaatcattagttgggctttactgttcttgctattgtatggcatatacatctgcctggatatatttctactcttgaccaaagttttgtaaagaacaatataagatttcgggtaggggtatggggagggaagatattttattgagaactacttaacaaaagatttatctgtaagcttgaactcaggagtacagttttagctatctagactctaacagcttttgctttaaaattattaaagtgtttcttaatgaaaaagaaaagatcttgctaaagttaaaataaggaacatttcaccttttaaatatttaattcttatgtggacttatttccagaaaactttggtgataattcttgagacaaaaggtggttaagtagcattattatgtaatgcttatataccatagagtttttaatagaagagaaatccatttcctccgagggtcactattaacaatgtacttccttaaatttagtttaatgattgtaatgggtgctgcatttgcacattgcattaagttatgatgagacgaattgttgttaaaaattatagcaaaaagaaatgtaaacttggttaaaatcctttcactctttgtattgttttttttaaggtttttattccttaaatgtaaaatgactacctaattttttgatgtaaatacattaaattcaaagagaaaaaaaatcagctgatgtagcagtatatcttttccttgatggttaaatattgatctagtatttatattgctgaattattttctgtggaggaccagataagcagtaagtatgtcttatcctatatgttttgcaacataaaaatattgctaattgaaaagaattaggcaattatgtgtgttgctgggttgtttttttgtttttttttttttgagacggagtcttgccctgtcgcccaggatggagtgcaacagcatgatctcggttcactgcaacctccatctcctgggatcaagtgattctcctgcctcagcctcctgaatagctgggattacaggcacctgccaccatgcctggctaattttttgtatctgtagtagagacggggtttcactgtgttggccaggatggtctcaaactcctgacctcctgatccacctgcctcggcctcccaaagtgctgggtttacaggcgtgagccaccgcgcccggccaaaattgaggtattttttgccctacgttttaaggactagacttttgaagtattttatagtctagaggtctcaagtaatatatatgtgtttaatatttttagagccaattgataccacaattagataggagtagtgagaataatatggaattacttggtttgaagtagttaaaaattggatatggttatatctgagctgtagtcatattatctcaagaaaaataatacgaggatttaacataagatttgttctattaatgcccaaatttggctttcctctactatcccccatagagaaccactaacaagtggatgtctaatattcctctggtgagttgaaggcaggagaagttgagaatcattagtttcaatgagtatccaggtgacctatcctggccctctactcagaaaccggcaatttgtcttcactctgagattcattaaattgctgttgtataactgatggttattatgaacactgacctgtgagacatatggaagataaagtttggtcttacaggaaatcttgaggagagtcaaaagagaaatgggagatgtctcttgagaggtgatcagagaagtttatgctcactgtctgatgcaaatgtctggtctatttgttagtaaataacagggaaatcattttcactttttgttaaaaataaggtatttacaagcataccttgtagttattgtgggttcagtttcagaccactgcaataaagtgaatatctcaataaagtgagtcacatgaagttttttggttttcccctgcatataaaagttacatttacaccatcctgtagtctattaagtgtgcagtagcattatggctaaaaaaaaaaaacacccaatatacctatcttaattaaagaattatttattgctgaaaaa

SEQ ID NO: 180102 - DNA, 3103 bp, Homo sapiens
  Payload ID: 15474
  Gene Symbol: SPTSSB
  Gene Name: serine palmitoyltransferase, small subunit B
  Uniprot ID: Q8NFR3
  ENST ID: ENST00000359175
  CDS Start-End: 1572-1802
attcatcaaaagaggctttcgctcccggactcccctgggcctcgagcagaaagcgtctcggccacggagatacagaaccgggagccttcaaggtcctccgccactctcagcaagccctgctctcgatggagaggagatcgctgggtgatggatgtgggcttccagggaaggtgctcgcgctggtcccgagccctccggggaagatattcgagcgcggagcgtaagcgcagggcacgccagccccgggagccgcgggagcaggcgccgcgcgtctctgcaccaccgggccgcctcccagccttctttccccagtttgccctcctgccgcagtccgggccgagattaattctctgcacttgtgagtgggcacacacaagttctccgggcacgatcctttcatctatttccctgggggagtccacctttttaacgattaacctcctagctaccgcgggcaaggtggcaggatgcgagtggggcggggaggggcgtttcacacgttcagaggcaccaaaattagctgccagtgctaaaaggctttgctttcttcggtttttgacaaataaatggggtgggatgcttgcttggccgcccgctgccccagcccgagccctgggctcacttagcagcctgatgccgagtttcagacgcagtcctgctgcgcttacacccgggcttcttcgcccccttgccaaagtctgcagcccgatggatgctgggcgcgggctttccctgagcgctttaacgcagcttaggctaaagccccagagctcccaccttctacctcctgtttatccgcccgcccctctaccaccgccaaaggacgtgccccttcagtagagtcggggatcccagccccagagcgggggagggcgcctccctatcccctcctccccgtccccgcctcggctcggggttttactgcagcagccggaggtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggagtgttgcagcaggcattctcttctggaaggagtcgctgggagcagtgcggttggacacaagtttgcgtaggagtgttttccttttgtcaataattaatcaccggaattagccaggtagaatttgagttttagcaagagtcctgagggcggggccgaacacctaactccgggaggctcccaggcgcccggcgcagtgggaagctcgcagcagctggggaggagccaaagcctcggcgctcacctaagccgcagggagatacacccaactgggagatgaggaaacagcaacccagagaggagaactaacccacacaggatcatttcgtgaaggagcaaggctgaagaaccagacctggactttcttaggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagactcctaacagacctaccagaatcatgcttaaagtgctcccttgacacttattctatactaaaggataaattttaaaaaatctttataggctactgtcagaagtatcctatccttgtttacgatgtataaaaagatgtgaataaattatatggaccccctaagtcttattttctagtaaactgatgatactggaaattcttttacttcaaatgcaaaagaataagctggaggcaattatttcctttcatacagagttcatgaattgttttaaatgcttcttaaagtctggctttataaccgtttaaaatcaacaatgttgattttagataaccaagtaagtattataatacaaaataattttaagtgtaagaaactaaagtataatcaaagtaaattcagttattgtatttgtggtgttgccttgccttgcatgatgctgggggaaaaagagaaaagaaatggttttctttttgtactttcattcagtgtagagggaaaaaagcatgtattgggccaccggaagacaagctaataaataggctggaagtaatattctaccagcaggaactcaacagctccagttaaatgctttgatatagtggctcctttgcagagccaaaacaagatttattaaatttccttcaaactgtttatctttaaaacaaatataaggttttaattatactgctgaagcaaatgtgaatgccaaagactacgttttgcagttttgctttcctcccaataaatattaatgtatgtaattctagagggtaaaaatgtaaataggtttggacaatatttgcacccttgtttgtgttatgaaaaaaatttttccaaggtgagctagagagaaagatgtttggcatgccaaattaacttgcatgtttgttaaaaaaacaaacacatgttttgaagagaaaccagatctgaacatgtatttgttgagttttgcaaaataaaattaattttgtaagtaaatatcta

SEQ ID NO: 180103 - DNA, 880 bp, Homo sapiens
  Payload ID: 15474
  Gene Symbol: SPTSSB
  Gene Name: serine palmitoyltransferase, small subunit B
  Uniprot ID: Q8NFR3
  ENST ID: ENST00000497137
  CDS Start-End: 332-562
agcagctggggaggagccaaagcctcggcgctcacctaagccgcagggagatacacccaactgggagatgaggaaacagcaacccagagaggagaactaacccacacaggatcatttcgtgaaggagcaaggctgaagaaccagacctggactttcttagtgctcattcctgggccctcgatcactgcatgtttgttacatggtccagtttgctgcttcctggaagagcatctcctgactgtgatgcctttgagaataaagtctttccgaagccattaatattcagaaggagccacatggacaaacttactgcagcttgaaggagccaaccatggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattgatcctgttcacattcagtgaaatggcattgcatatttatatgttgcttacagcttattgatttaggtaactattgtgtcttccttcactatctgacctgaaaagcactctcttctctatgcactcttatattctgcctttctgcctggagtttgaaatacatgtctctttagtttcttttgcacatgctacattgtgctttagaccggagataatacagtgactttacctcacaaatcatattctgtcaacacaaatctatgaatttagtttatttaaaatcagaacaatttcctacaaaatttttctggaaaatagac

SEQ ID NO: 180104 - DNA, 231 bp, Homo sapiens
  Payload ID: 15474
  Gene Symbol: SPTSSB
  Gene Name: serine palmitoyltransferase, small subunit B
  Uniprot ID: Q8NFR3
  ENST ID: ENST00000620149
  CDS Start-End: 1-231
atggatttgaggcgtgtgaaggaatatttctcctggctctactatcaataccaaatcattagctgctgtgctgttttagagccctgggagcgatctatgtttaacaccatcttactaaccattattgctatggtggtatacactgcctatgtctttattccaatccacattcgcctggcttgggaatttttctcaaaaatatgtggatatcacagtacaatttctaattga

SEQ ID NO: 180105 - DNA, 1292 bp, Homo sapiens
  Payload ID: 15474
  Gene Symbol: SPTSSB
  Gene Name: serine palmitoyltransferase, small subunit B
  ENST ID: ENST00000617024
  CDS Start-End: 89-781
ggccacggagatacagaaccgggagccttcaaggtcctccgccactctcagcaagccctgctctcgatggagaggagatcgctgggtgatggatgtgggcttccagggaaggtgctcgcgctggtcccgagccctccggggaagatattcgagcgcggagcgtaagcgcagggcacgccagccccgggagccgcgggagcaggcgccgcgcgtctctgcaccaccgggccgcctcccagccttctttccccagtttgccctcctgccgcagtccgggccgagattaattctctgcacttgtgagtgggcacacacaagttctccgggcacgatcctttcatctatttccctgggggagtccacctttttaacgattaacctcctagctaccgcgggcaaggtggcaggatgcgagtggggcggggaggggcgtttcacacgttcagaggcaccaaaattagctgccagtgctaaaaggctttgctttcttcggtttttgacaaataaatggggtgggatgcttgcttggccgcccgctgccccagcccgagccctgggctcacttagcagcctgatgccgagtttcagacgcagtcctgctgcgcttacacccgggcttcttcgcccccttgccaaagtctgcagcccgatggatgctgggcgcgggctttccctgagcgctttaacgcagcttaggctaaagccccagagctcccaccttctacctcctgtttatccgcccgcccctctaccaccgccaaaggacgtgccccttcagtagagtcggggatcccagccccagagcgggggagggcgcctccctatcccctcctccccgtccccgcctcggctcggggttttactgcagcagccggaggtgacagcgacgcctcagccgcctctgttgctctcggagccccggcttcccctgcaccgggaaagcgccccctctcgagaggctggtccctggagaactgcgaacgagctgcagaaaaccagattttaaaatgtagaagtcgttgggctgcattcctccgaggaccagtctgatcgcccaggactaagagtggcagcgtatgagaagttgggaccatagagcaagggggggaggggagtgttgcagcaggcattctcttctggaaggagtcgctgggagcagtgcggttggacacaagtttgcgtaggagtgttttccttttgtcaataattaatcaccggaattagccaggtagaatttgagttttagcaagagtcctgagggcggggccgaacacctaactccgggaggctcc

SEQ ID NO: 180106 - DNA, 542 bp, Homo sapiens
  Payload ID: 15475
  Gene Symbol: SPINK1
  Gene Name: serine peptidase inhibitor, Kazal type 1
  Uniprot ID: P00995
  ENST ID: ENST00000296695
  CDS Start-End: 210-449
ttcacctttcttacacaggtgacattcccagaacctggaggccaggctatgacacagagtcaatcaataaccagggagatctgtgatatagcccagtaggtggggccttgctgccatctgccatatgacccttccagtcccaggcttctgaagagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggaaacgccagacttctatcctcattcaaaaatctgggccttgctgagaaccaaggttttgaaatcccatcaggtcaccgcgaggcctgactggccttattgttgaataaatgtatctgaatatcccctgttgtttccat

SEQ ID NO: 180107 - DNA, 1188 bp, Homo sapiens
  Payload ID: 15475
  Gene Symbol: SPINK1
  Gene Name: serine peptidase inhibitor, Kazal type 1
  ENST ID: ENST00000510027
  CDS Start-End: 59-256
agagacgtggtaagtgcggtgcagttttcaactgacctctggacgcagaacttcagccatgaaggtaacaggcatctttcttctcagtgccttggccctgttgagtctatctggtaacactggagctgactccctgggaagagaggccaaatgttacaatgaacttaatggatgcaccaagatatatgaccctgtctgtgggactgatggaaatacttatcccaatgaatgcgtgttatgttttgaaaatcggtgagtacaaacttgagtttcttttaaactatatattttaagttagttatcttcaagtgtactgataatatgaatctcaccccgagaaaagcaaactatttactttttccaaaaacagttatctctttcttattctcccttttatatatttagcattaaatattattttttagaagtcacttgtatgataaaagcctatattttttacagcaaaatagtcgatagcttggatttttataaagtacacacaaaatacctttaattaaaaaaattattagtggttgcaatgattgtgttttttaaagccctcagttatgcaaatataaattgtatagattatataaccaaaaatatatttttacttatggatatgaaagccagtttcagtaaagcttcatttcctcagtgaccataagtaggtgatgtgatacagagaaatagattcaacacagatttcctatctcactcagcaactgaaaccttagcatgtctcaagcatcatgctaatattccctgtcttacttgtgcttatgactaagaaaacatcatgagcatgtataggatggcttcttataacttggggcaaatgccagaagatgaggtgtaaataaagtgcaacaggagtgaagcagagatacatattttttattaaaaggggccaagaaaggatccatgaaaagaatagaatgccagccgggtgcagtggctcactcctgtaatcccagcactttgggaggccgatgcaggtggatcacctgagaccagcctggccaacatggtgaaaccccatggtggcgggcgcctataataccagctactcaggaggctgaggcagaagaatcgcttcaatctgggaggcagaggttgcagtgagctgagattgtgccactgcactccaacctgggtgacaagagtgagactccatcttaaaaaaaa

SEQ ID NO: 180108 - DNA, 509 bp, Homo sapiens
  Payload ID: 15476
  Gene Symbol: SPINK13
  Gene Name: serine peptidase inhibitor, Kazal type 13 (putative)
  Uniprot ID: Q1W4C9
  ENST ID: ENST00000398450
  CDS Start-End: 63-347
gcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaacca

SEQ ID NO: 180109 - DNA, 1022 bp, Homo sapiens
  Payload ID: 15476
  Gene Symbol: SPINK13
  Gene Name: serine peptidase inhibitor, Kazal type 13 (putative)
  Uniprot ID: Q1W4C9
  ENST ID: ENST00000512953
  CDS Start-End: 532-816
acaaaagagtgctaactactctaggagagattaaagcctgtgaaatagaacttttccagataatggcgagtttttaggcttgctcatgctgaagcttaatataagctaataagtagagaaattaggaggcttggatattgcaaactttattggttggggtgttacccaggctaatagaaaaaaaattatatcctagaaagacagaacaggtgcgacttctgagaagaaaggttagagaagactagaaaggctgggaccaccttgaatttggcacacacacacacacacccacacgcacacacaaaatcaccaaatgatctggaatgtgctatgcgatgagtcagcctccactgctgtacgtccttggctacagactcctggaacagcagctcttctcaaggctagttgtgacagactcctggaacagcagctcttctcaaggctagttgtgacatccaaagtgacaagagcaggcccatattcagccacctcatccaggccttatcaaagaagagtcttatatgagatcaaatggctgcctttccccacaagattatatttttcctggtatgctctactttgacacatgtggctttctcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaaccaaatatcacatttgttacaaataaacaacaaaagagctgatattc

SEQ ID NO: 180110 - DNA, 661 bp, Homo sapiens
  Payload ID: 15476
  Gene Symbol: SPINK13
  Gene Name: serine peptidase inhibitor, Kazal type 13 (putative)
  Uniprot ID: Q1W4C9
  ENST ID: ENST00000511106
  CDS Start-End: 335-499
gcaggcccatattcagccacctcatccaggccttatcaaagaagagtcttatatgagatcaaatggctgcctttccccacaagattatatttttcctggtatgctctactttgacacatgtggctttctcaggtggaacaatataatcacaaggattcttatcagagggaggcaggagggcccaagtcagagaagatgtgacaatggaagcagaagttagaatggtgcagtaaaagggccatgggccgaggaactcagacagcctgtagaagctggaaaagcaggaattttcaataaacgtgacttcactaggtggcctaagccccgatgtaaaatgtatatcccactggaccctgattacaatgcagactgccccaatgtgacagcacctgtttgtgcctcaaatggccacactttccagaatgagtgtttcttttgtgttgaacagagggaatttcattatcgtataaaatttgaaaaatatggaaaatgtgattaatgggtaccagagtaactacacttgcttattctttttctacttaattcagaatagtatttcttttagagtgtgagaatgtaaattaaataacatccctatgctgtacttaaatgtcgaacaaaatgagagacaaaaatgaaggaatcaaactgacaagaacca

SEQ ID NO: 180111 - DNA, 294 bp, Homo sapiens
  Payload ID: 15477
  Gene Symbol: SPINK14
  Gene Name: serine peptidase inhibitor, Kazal type 14 (putative)
  Uniprot ID: Q6IE38
  ENST ID: ENST00000356972
  CDS Start-End: 1-294
atggccaaatctttcccagtattctcacttttgtcctttatcttgatacatttggtgttatcttctgtttcaggccctagacactggtggccaccacgtggaattattaaggtgaaatgtccatatgagaaagtaaacttgagctggtacaatggaacggtcaacccctgccctggcttatatcaacccatctgcggcaccaattttataacctatgataatccctgcattctgtgtgttgagagcttgaaatctcatggaagaatcaggttttaccatgatggaaaatgttag

SEQ ID NO: 180112 - DNA, 157 bp, Homo sapiens
  Payload ID: 15477
  Gene Symbol: SPINK14
  Gene Name: serine peptidase inhibitor, Kazal type 14 (putative)
  ENST ID: ENST00000562793
  CDS Start-End: 1-144
atggccaaatctttcccagtattctcacttttgtcctttatcttgatacatttggtgttatcttctgtttcaggccctagacactggtggccaccacgtggaattattaaggaaatctcatggaagaatcaggttttaccatgatggaaaatgttag

SEQ ID NO: 180113 - DNA, 613 bp, Homo sapiens
  Payload ID: 15478
  Gene Symbol: SPINK2
  Gene Name: serine peptidase inhibitor, Kazal type 2 (acrosin-trypsin inhibitor)
  Uniprot ID: P20155
  ENST ID: ENST00000248701
  CDS Start-End: 81-335
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 180114 - DNA, 659 bp, Homo sapiens
  Payload ID: 15478
  Gene Symbol: SPINK2
  Gene Name: serine peptidase inhibitor, Kazal type 2 (acrosin-trypsin inhibitor)
  ENST ID: ENST00000504762
  CDS Start-End: 33-392
cgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacgcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcag

SEQ ID NO: 180115 - DNA, 763 bp, Homo sapiens
  Payload ID: 15478
  Gene Symbol: SPINK2
  Gene Name: serine peptidase inhibitor, Kazal type 2 (acrosin-trypsin inhibitor)
  ENST ID: ENST00000506738
  CDS Start-End: 81-485
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagcctctctgatccctcaatttggtctgttttcaaaatatagaacgccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattca

SEQ ID NO: 180116 - DNA, 608 bp, Homo sapiens
  Payload ID: 15478
  Gene Symbol: SPINK2
  Gene Name: serine peptidase inhibitor, Kazal type 2 (acrosin-trypsin inhibitor)
  ENST ID: ENST00000618802
  CDS Start-End: 81-485
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattc

SEQ ID NO: 180117 - DNA, 677 bp, Homo sapiens
  Payload ID: 15478
  Gene Symbol: SPINK2
  Gene Name: serine peptidase inhibitor, Kazal type 2 (acrosin-trypsin inhibitor)
  ENST ID: ENST00000616980
  CDS Start-End: 81-347
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacgccagccaaactgctctcagtatagattaccaggatgtcccagacactttaaccctgtgtgtggcagtgacatgtccacttatgccaatgaatgtactctgtgcatgaaaatcagggaaggtggtcataatattaaaatcattcgaaatggaccctgctgatggagcagtttacagaaaagaagatggagagaccaccttcactggcagactagataaattgcatttcccctttttctcttttcctgtgtttctttacatgagatttgttaacacacattttctgagagcaggtatggaagacagccatgtgtagtgatggataatttaaagaaaaaaagaatccttgtttcttggcttttgctcctggagttaagcttactgcccaggtgacttgtgcattgctttatttagttgaaataaaatcagcattgaattc

SEQ ID NO: 180118 - DNA, 392 bp, Homo sapiens
  Payload ID: 15478
  Gene Symbol: SPINK2
  Gene Name: serine peptidase inhibitor, Kazal type 2 (acrosin-trypsin inhibitor)
  ENST ID: ENST00000631082
  CDS Start-End: 81-392
cgcgccccgtcgcacgagcgctccctgcgagtggcgcaggtaacagaccgcaggggcaagacagccggcgcgggaggaggatggcgctgtcggtgctgcgcttggcgctgctgctcctggcagttaccttcgcaggtagcgctcggagcggtcctggcgagcggggacctccggagaaaagcgggtttgggagtcagaccggcggcggaccctgccctgctccgggcggcctcggcgacggtacccgcgcgcccgttactggcggttccccagaggacctgccagatatccaaactgctctcagtatagattaccaggatgtcccagacactttaaccctgtgtgtggcagtgacatgtccacttatgccaatgaatgtactctgtgcatga

SEQ ID NO: 180119 - DNA, 402 bp, Homo sapiens
  Payload ID: 15479
  Gene Symbol: SPINK4
  Gene Name: serine peptidase inhibitor, Kazal type 4
  Uniprot ID: O60575
  ENST ID: ENST00000379721
  CDS Start-End: 46-306
ggcgcaggccccagccagctcaggctacactatcccaggatcagcatggccgtccgccagtgggtaatcgccctggccttggctgccctccttgttgtggacagggaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaagatccagcccaactga

SEQ ID NO: 180120 - DNA, 533 bp, Homo sapiens
  Payload ID: 15479
  Gene Symbol: SPINK4
  Gene Name: serine peptidase inhibitor, Kazal type 4
  ENST ID: ENST00000379725
  CDS Start-End: 123-452
ttctgcaaatgggaggtactggaaagaacgtgagggcaggaggagagatatgccagggtatttattgccctagctccccctctgccagaccacaggtagaatagcaagaagtctacatcctgatgatcctgggcattgggagctcacctcaccttctctggactctggagggcacacacatatggtccctgctgggggatgcttcgcacacagaccgtcttccagaggcaggggcagggaaactgctgtcagaagtgccagtggcagcaggaaagctccctttctcaagaatgcccatctgtgaacacatggtagagtctccaacctgttcccagatgtccaacctggtctgcggcactgatgggctcacatatacgaatgaatgccagctctgcttggcccggataaaaaccaaacaggacatccagatcatgaaagatggcaaatgctgatcccacaggagcacctcaagccatgaagtgtcagctggagaacagtggtgggcatggagaggatatgacatgaaataaaag

SEQ ID NO: 180121 - DNA, 3535 bp, Homo sapiens
  Payload ID: 15480
  Gene Symbol: SPINK5
  Gene Name: serine peptidase inhibitor, Kazal type 5
  Uniprot ID: Q9NQ38
  ENST ID: ENST00000256084
  CDS Start-End: 43-3237
atgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccct

SEQ ID NO: 180122 - DNA, 3656 bp, Homo sapiens
  Payload ID: 15480
  Gene Symbol: SPINK5
  Gene Name: serine peptidase inhibitor, Kazal type 5
  Uniprot ID: Q9NQ38
  ENST ID: ENST00000359874
  CDS Start-End: 74-3358
ccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggaccagtgcagacaggttcagaatgaagcggaggatgcaaaatttagacaacctgggcgttccttggcctctgttgccaggatgagtacagatgagtgcagtgaatttcgaaactatataaggaacaatgaactcatctgccctagagagaatgacccagtgcacggtgctgatggaaagttctatacaaacaagtgctacatgtgcagagctgtctttctaacagaagctttggaaagggcaaagcttcaagaaaagccatcccatgttagagcttctcaagaggaagacagcccagactctttcagttctctggattctgagatgtgcaaagactaccgagtattgcccaggataggttatctttgtccaaaggatttaaagcctgtctgtggtgacgatggccaaacctacaacaatccttgcatgctctgtcatgaaaacctgatacgccaaacaaatacacacatccgcagtacagggaagtgtgaggagagcagcaccccaggaaccaccgcagccagcatgcccccgtctgacgaatgacaggaagattgttgaaagccatgagggaaaaaataaaccccagttctgaatcacctaccttcaccatctgtatatacaaagaattcttcggagcttgtcttatttgctatagaaaacaatacagagcttttgggaatggactcactgattttcagtcttttccatctctttcctcctagactctgtgatctgagggtataaagacatctccaccaagtctgagccctcaaaatgtcctgattacaatgctgtctgtccaactgcctgttcaataaaagtaaactcagcagaacaccct

SEQ ID NO: 180123 - DNA, 2915 bp, Homo sapiens
  Payload ID: 15480
  Gene Symbol: SPINK5
  Gene Name: serine peptidase inhibitor, Kazal type 5
  Uniprot ID: Q9NQ38
  ENST ID: ENST00000398454
  CDS Start-End: 74-2824
ccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctttgatcgagaagctaatgaaagaaaaaagaaagatgaagagaaatcaagtagcaagccctcaaataatgcaaaggttatttattaaaggataccaaaataaccattttacttttcaccttcagaattttgcattcttctccagctttgggaataataaatatattaatatcttaact

SEQ ID NO: 180124 - DNA, 2674 bp, Homo sapiens
  Payload ID: 15480
  Gene Symbol: SPINK5
  Gene Name: serine peptidase inhibitor, Kazal type 5
  ENST ID: ENST00000508733
  CDS Start-End: 66-2674
agtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcaggatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaattgtgaaactctgcagtcaatatcaaaatcaggcaaagaatggaatacttttctgtaccagagaaaatgaccctattcgtggtccagatgggaaaatgcatggcaacttgtgttccatgtgtcaagcctacttccaagcagaaaatgaagaaaagaaaaaggctgaagcacgagctagaaacaaaagagaatctggaaaagcaacctcatatgcagagctttgcagtgaatatcgaaagcttgtgaggaacggaaaacttgcttgcaccagagagaacgatcctatccagggcccagatgggaaagtgcatggcaacacctgctccatgtgtgaggtcttcttccaagcagaagaagaagaaaagaaaaagaaggaaggtaaatcaagaaacaaaagacaatctaagagtacagcttcctttgaggagttgtgtagtgaataccgcaaatccaggaaaaacggacggcttttttgcaccagagagaatgaccccatccagggcccagatggaaaaatgcatggcaacacctgctccatgtgtgaggccttctttcaacaagaagaaagagcaagagcaaaggctaaaagagaagctgcaaaggaaatctgcagtgaatttcgggaccaagtgaggaatggaacacttatatgcaccagggagcataatcctgtccgtggcccagatggcaaaatgcatggaaacaagtgtgccatgtgtgccagtgtgttcaaacttgaagaagaagagaagaaaaatgataaagaagaaaaagggaaagtcgaggctgaaaaagttaagagagaagcagttcaggagctgtgcagtgaatatcgtcattatgtgaggaatggacgactcccctgtaccagagagaatgatcctattgagggtctagatgggaaaatccacggcaacacctgctccatgtgtgaagccttcttccagcaagaagcaaaagaaaaagaaagagctgaacccagagcaaaagtcaaaagagaagctgaaaaggagacatgcgatgaatttcggagacttttgcaaaatggaaaacttttctgcacaagagaaaatgatcctgtgcgtggcccagatggcaagacccatggcaacaagtgtgccatgtgtaaggcagtcttccagaaagaaaatgaggaaagaaagaggaaagaagaggaagatcagagaaatgctgcaggacatggttccagtggtggtggaggaggaaacactcaggacgaatgtgctgagtatcgggaacaaatgaaaaatggaagactcagctgtactcgggagagtgatcctgtacgtgatgctgatggcaaatcgtacaacaatcagtgtaccatgtgtaaagcaaaattggaaagagaagcagagagaaaaaatgagtattctcgctccagatcaaatgggactggatcagaatcagggaaggatacatgtgatgagtttagaagccaaatgaaaaatggaaaactcatctgcactcgagaaagtgaccctgtccggggtccagatggcaagacacatggcaataagtgtactatgtgtaaggaaaaactggaaagggaagcagctgaaaaaaaaaagaaagaggatgaagacaggagcaatacaggagaaaggagcaatacaggagaaaggagcaatgacaaagaggatctgtgtcgtgaatttcgaagcatgcagagaaatggaaagcttatctgcaccagagaaaataaccctgttcgaggcccatatggcaagatgcacatcaataaatgtgctatgtgtcagagcatctt

SEQ ID NO: 180125 - DNA, 1073 bp, Homo sapiens
  Payload ID: 15480
  Gene Symbol: SPINK5
  Gene Name: serine peptidase inhibitor, Kazal type 5
  ENST ID: ENST00000476697
  CDS Start-End: 66-671
agtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggaaatgtgccatgaatttcaggcatttatgaaaaatggaaaactgttctgtccccaggataagaaattttttcaaagtcttgatggaataatgttcatcaataaatgtgccacgtgcaaaatgatactggaaaaagaagcaaaatcacagaagagggccaggcatttagcaagagctcccaaggctactgccccaacagagctgaattgtgatgattttaaaaaaggagaaagagatggggattttatctgtcctgattattatgaagctgtttgtggcacagatgggaaaacatatgacaacagatgtgcactgtgtgctgagaatgcgaaaaccgggtcccaaattggtgtaaaaagtgaaggggaatgtaagagcagtaatccagagcagttttgtgagcctgtgatggtaggggaaggggaaggaagaaaggatctcatacatgtcacacttgtctttttccaggagattgggagcaagttgatggcaaggactgtgctctgtctgagttctggcacatagatgtatgcagtgcttttcggccctttgttagagatggaagacttggatgcacaagggaaaatgatcctgttcttggtcctgatgggaagacgcatggcaataagtgtgcaatgtgtgctgagctgtttttaaaagaagctgaaaatgccaagcgagagggtgaaactagaattcgacgaaatgctgaaaaggatttttgcaaggaatatgaaaaacaagtgagaaatggaaggcttttttgtacacgggagagtgatccagtccgtggccctgacggcaggatgcatggcaacaaatgtgccctgtgtgctgaaattttcaagcagcgtttttcagaggaaaacagtaaaacagatcaaaatttgggaaaagctgaagaaaaaactaaagttaaaagagaaa

SEQ ID NO: 180126 - DNA, 492 bp, Homo sapiens
  Payload ID: 15480
  Gene Symbol: SPINK5
  Gene Name: serine peptidase inhibitor, Kazal type 5
  ENST ID: ENST00000521206
  CDS Start-End: 287-492
acgtgcacattttttgttctcactctaataatgtgataaagctgaattatttccaattttctgacgagagaggtcaagagacttgttcaaggtcttttctcttggatcctaaaggatggaagctaaagtggtgtggtatataagtcccatgaccttgaacaactggttttatgtgggtgtcaccagtgctttataaaagtaaactgcatcgccccgagttcagtcatactgcaccagctgagcaatgcatggagtggacctgtaggcgacttgcatcgtcttcaacatgaagatagccacagtgtcagtgcttctgcccttggctctttgcctcatacaagatgctgccagtaagaatgaagatcaggataagaaattttttcaaagtcttgatggaataatgttcatcaataaatgtgccacgtgcaaaatgatactggaaaaagaagcaaaatcacagaagagggccaggcatttagcaagagctcccaa

SEQ ID NO: 180127 - DNA, 686 bp, Homo sapiens
  Payload ID: 15481
  Gene Symbol: SPINK6
  Gene Name: serine peptidase inhibitor, Kazal type 6
  Uniprot ID: Q6UWN8
  ENST ID: ENST00000325630
  CDS Start-End: 257-499
ggaaaatgtaggctaccagtagaaaatgacattctctattaataagatctgaggtgcgacacacataattgtcccaatttttaagattgatggggagcatgaagcatttttttaatgtgttggcaggccccattaaatgcataaactgcataggactcatgtggtctgaatgtattttagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagca

SEQ ID NO: 180128 - DNA, 300 bp, Homo sapiens
  Payload ID: 15481
  Gene Symbol: SPINK6
  Gene Name: serine peptidase inhibitor, Kazal type 6
  ENST ID: ENST00000514389
  CDS Start-End: 177-300
gtagtgaaactttagaaagaagagccgggaggatgtattggttgttaggaaaatgtaggctaccagtagaaaatgacattctctattaataagatctgagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactc

SEQ ID NO: 180129 - DNA, 605 bp, Homo sapiens
  Payload ID: 15481
  Gene Symbol: SPINK6
  Gene Name: serine peptidase inhibitor, Kazal type 6
  Uniprot ID: Q6UWN8
  ENST ID: ENST00000621437
  CDS Start-End: 177-419
gtagtgaaactttagaaagaagagccgggaggatgtattggttgttaggaaaatgtaggctaccagtagaaaatgacattctctattaataagatctgagggctttctgggaattgtcttgacagagaacctcagctggacaaagcagccttgatctgagtgagctaactgacacaatgaaactgtcaggcatgtttctgctcctctctctggctcttttctgctttttaacaggtgtcttcagtcagggaggacaggttgactgtggtgagttccaggaccccaaggtctactgcactcgggaatctaacccacactgtggctctgatggccagacatatggcaataaatgtgccttctgtaaggccatagtgaaaagtggtggaaagattagcctaaagcatcctggaaaatgctgagttaaagccaatgtttcttggtgacttgccagcttttgcagccttcttttctcacttctgcttatacttttgctggtggattcctttaattcataaagacatacctactctgcctgggtcttgaggagttcaatgtatgtctatttctcttgattcacttgtcaataaagtacattctgcaaaagc

SEQ ID NO: 180130 - DNA, 557 bp, Homo sapiens
  Payload ID: 15482
  Gene Symbol: SPINK7
  Gene Name: serine peptidase inhibitor, Kazal type 7 (putative)
  Uniprot ID: P58062
  ENST ID: ENST00000274565
  CDS Start-End: 62-319
atggtcgatgcagctgtagtgacaatctcagagcagcttctacaccacagccatttccagcatgaagatcactgggggtctccttctgctctgtacagtggtctatttctgtagcagctcagaagctgctagtctgtctccaaaaaaagtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtgggggacagagccagattcagagtaatcttgactgaatggagaaagtttctgtgctacccctacaaacccatgcctcactgacagaccagcattttttttttaacacgtcaataaaaaaataatctcccagaaagtt

SEQ ID NO: 180131 - DNA, 299 bp, Homo sapiens
  Payload ID: 15482
  Gene Symbol: SPINK7
  Gene Name: serine peptidase inhibitor, Kazal type 7 (putative)
  ENST ID: ENST00000523535
  CDS Start-End: 18-197
aggacatttgcttgtatatgacacaggtggactgcagcatttacaagaagtatccagtggtggccatcccctgccccatcacatacctaccagtttgtggttctgactacatcacctatgggaatgaatgtcacttgtgtaccgagagcttgaaaagtaatggaagagttcagtttcttcacgatggaagttgctaaattctccatggacatagagagaaaggaatgatattctcatcatcatcttcatcatcccaggctctgactgagtttctttcagttttactgatgttctgggtg

SEQ ID NO: 180132 - DNA, 444 bp, Homo sapiens
  Payload ID: 15483
  Gene Symbol: SPINK8
  Gene Name: serine peptidase inhibitor, Kazal type 8 (putative)
  Uniprot ID: P0C7L1
  ENST ID: ENST00000434006
  CDS Start-End: 1-294
atgaaggggatctgctcagacgccatccttgttctagctacctccatgtggatggcctttgcaattgacttcccccttcctatggcctctgaaagaggtcagctagacaaaacaatagttgaatgcctcaagaatgtaaataagtgctggtttttatcctacatcaagcccagtgaacctatttgtggcagtgaccaggttacctacagtagtgactgccatctgtgctccaaaattctatttgaagggcttaacataactaaactgtatgatggacaatgtgaaaactcttgaacgtacgacaaagaattataaaacctactgaatctccagattgccaagtgaaacacaatggttgcctcttcaaatatatcccctttaattactaatggttggatcaaactcgttgatttatgtcttcaataaatgattcttagcagaaaa

SEQ ID NO: 180133 - DNA, 453 bp, Homo sapiens
  Payload ID: 15484
  Gene Symbol: SPINK9
  Gene Name: serine peptidase inhibitor, Kazal type 9
  Uniprot ID: Q5DT21
  ENST ID: ENST00000377906
  CDS Start-End: 56-316
ggacaccaggtcacttcttttccctacatctgactgccttggccacttcagtactatgagagcaacagccatagtcctactcttggctctgacacttgcaaccatgttcagtatagaatgtgccaaacagacgaaacagatggttgactgcagtcattataaaaagttaccaccaggacaacagagattttgtcatcatatgtatgatccaatttgtggatctgatggcaaaacttataaaaatgattgcttcttctgttctaaagttaagaaaactgacggcacacttaaatttgtacattttggaaaatgttaaatctatcttgtgagtccaaaatatcttttaatgcatctattcacaagagtcacatttctgttcccatattatctatgccacattgcctactcatcaccatatgtagatttctttgtagaataaagcagatataaggg

SEQ ID NO: 180134 - DNA, 604 bp, Homo sapiens
  Payload ID: 15484
  Gene Symbol: SPINK9
  Gene Name: serine peptidase inhibitor, Kazal type 9
  ENST ID: ENST00000511717
  CDS Start-End: 271-594
tactccgagctacaggaggaaattcaaaccaaaggcaaagaagttgaaaactttgaaaaaaatttagacgaatgtataactagaataaccaatacagagaagtgcttaaaggagctgatggagctgaaagccaaggctcaagaactacatgaagaatgcaaaagcctcaggagccgatgcgatcaactggaagaaagggttaggtattggagaagaagtgatttcattgagatttgtctctctgtgtgatcaatcagcatttgcatctttatggtctttatgaatccttctcatcattgttttcattataaaactccaccaagcagctcaggagaacacaatgaacccaggagactcatgggcttaacgcaacctgaacatttacaaggtatagaatgtgccaaacagacgaaacagatggttgactgcagtcattataaaaagttaccaccaggacaacagagattttgtcatcatatgtatgatccaatttgtggatctgatggcaaaacttataaaaatgattgcttcttctgttctaaagttaagaaaactgacggcacacttaaatttgtacattttggaaaatgttaaatctatcttg

SEQ ID NO: 180135 - DNA, 3056 bp, Homo sapiens
  Payload ID: 15485
  Gene Symbol: SPINT1
  Gene Name: serine peptidase inhibitor, Kunitz type 1
  Uniprot ID: O43278
  ENST ID: ENST00000344051
  CDS Start-End: 235-1824
atgtcggccccgccccgacggcgctgactcagtttcaccagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtggagtttctggctctgttctgtgggccaggagagggactaggttgctggggggtgatgggaccgtcctgttcagctggttcaggcttcagccaccctgttgagcaggttttcccatcgtctctctcgaaactggcctggcccctgactttggagagcagtgccatgtttgaccaccagaggggaggagtgagcgggccacgggagccacgagtgtggggaggctgcagtgctgctgtgtagcatttcttcctggtgtgagcctctccacaagcctgttgagtggttgagctctccacaattctgctcatttggaggttggggttaggggtgcacaggcaccttggctcctacctccatgttagggcccaggtgactagctgtctccctcccaacagaagccctggcttctgcgctggagtgcagcacccccaaccaggctctgagctccttcccaggagcctttagtagagacacgccactccaacccacacccctgcatttgttcaagctacctcccggtgccaaaaaaaaaaaaaaatcatactttgagctca

SEQ ID NO: 180136 - DNA, 883 bp, Homo sapiens
  Payload ID: 15485
  Gene Symbol: SPINT1
  Gene Name: serine peptidase inhibitor, Kunitz type 1
  ENST ID: ENST00000564375
  CDS Start-End: 1-883
gaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggc

SEQ ID NO: 180137 - DNA, 611 bp, Homo sapiens
  Payload ID: 15485
  Gene Symbol: SPINT1
  Gene Name: serine peptidase inhibitor, Kunitz type 1
  ENST ID: ENST00000569589
  CDS Start-End: 1-611
gcttgggcaacaagaacaactaccttcgggaagaagagtgcattctagcctgtcggggtgtgcaaggtgggcctttgagaggcagctctggggctcaggcgactttcccccagggcccctccatggaaaggcgccatccagacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggccc

SEQ ID NO: 180138 - DNA, 720 bp, Homo sapiens
  Payload ID: 15485
  Gene Symbol: SPINT1
  Gene Name: serine peptidase inhibitor, Kunitz type 1
  ENST ID: ENST00000566928
  CDS Start-End: 1-720
atgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtag

SEQ ID NO: 180139 - DNA, 940 bp, Homo sapiens
  Payload ID: 15485
  Gene Symbol: SPINT1
  Gene Name: serine peptidase inhibitor, Kunitz type 1
  ENST ID: ENST00000568823
  CDS Start-End: 1-940
gggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacgga

SEQ ID NO: 180140 - DNA, 2456 bp, Homo sapiens
  Payload ID: 15485
  Gene Symbol: SPINT1
  Gene Name: serine peptidase inhibitor, Kunitz type 1
  Uniprot ID: O43278
  ENST ID: ENST00000562057
  CDS Start-End: 235-1776
atgtcggccccgccccgacggcgctgactcagtttcaccagaaaccagggggagaaggcggccgagccccagctctccgagcaccgggtcggaagccgcgacccgagccgcgcaggaagctgggaccggaacctcggcggacccggccccacccaactcacctgcgcaggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggcccctccatggaaaggcgccatccagtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtctataaccacaccacgcggcccctctgagcctgggtctcaccggctctcacctggccctgcttcctgcttgccaaggcagaggcctgggctgggaaaaactttggaaccagactcttgcctgtttcccaggcccactgtgcctcagagaccagggctccagcccctcttggagaagtctcagctaagctcacgtcctgagaaagctcaaaggtttggaaggagcagaaaacccttgggccagaagtaccagactagatggacctgcctgcataggagtttggaggaagttggagttttgtttcctctgttcaaagctgcctgtccctaccccatggtgctaggaagaggagtggggtggtgtcagaccctggaggccccaaccctgtcctcccgagctcctcttccatgctgtgcgcccagggctgggaggaaggacttccctgtgtagtttgtgctgtaaagagttgctttttgtttatttaatgctgtggcatgggtgaagaggaggggaagaggcctgtttggcctctctatcctctcttcctcttcccccaagattgagctctctgcccttgatcagccccaccctggcctagaccagcagacagagccaggagaagctcagctgcattccgcagcccccacccccaaggttctccaacatcacagcccagcccgcccactgggtaataaaagtggtttgtgga

SEQ ID NO: 180141 - DNA, 1072 bp, Homo sapiens
  Payload ID: 15485
  Gene Symbol: SPINT1
  Gene Name: serine peptidase inhibitor, Kunitz type 1
  ENST ID: ENST00000563656
  CDS Start-End: 168-1072
acctgcgcaggtaacccgggcccccgcgcgcaaggccgaggcgcaggcggagcgggctggagcatgtccggccctttgttctgcgctcgtgcgtgtgtccgggtcaccagcaccctcggaacccagaggcccgcgctctgaaggtgacccccctggggaggaaggcgatggcccctgcgaggacgatggcccgcgcccgcctcgccccggccggcatccctgccgtcgccttgtggcttctgtgcacgctcggcctccagggcacccaggccgggccaccgcccgcgccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcgggg

SEQ ID NO: 180142 - DNA, 1417 bp, Homo sapiens
  Payload ID: 15485
  Gene Symbol: SPINT1
  Gene Name: serine peptidase inhibitor, Kunitz type 1
  ENST ID: ENST00000568580
  CDS Start-End: 1-1417
ccccctgggctgcccgcgggagccgactgcctgaacagctttaccgccggggtgcctggcttcgtgctggacaccaacgcctcggtcagcaacggagctaccttcctggagtcccccaccgtgcgccggggctgggactgcgtgcgcgcctgctgcaccacccagaactgcaacttggcgctagtggagctgcagcccgaccgcggggaggacgccatcgccgcctgcttcctcatcaactgcctctacgagcagaacttcgtgtgcaagttcgcgcccagggagggcttcatcaactacctcacgagggaagtgtaccgctcctaccgccagctgcggacccagggctttggagggtctgggatccccaaggcctgggcaggcatagacttgaaggtacaaccccaggaacccctggtgctgaaggatgtggaaaacacagattggcgcctactgcggggtgacacggatgtcagggtagagaggaaagacccaaaccaggtggaactgtggggactcaaggaaggcacctacctgttccagctgacagtgactagctcagaccacccagaggacacggccaacgtcacagtcactgtgctgtccaccaagcagacagaagactactgcctcgcatccaacaaggtgggtcgctgccggggctctttcccacgctggtactatgaccccacggagcagatctgcaagagtttcgtttatggaggctgcttgggcaacaagaacaactaccttcgggaagaagagtgcattctagcctgtcggggtgtgcaaggtgggcctttgagaggcagctctggggctcaggcgactttcccccaggtgtgctctggcacctgtcagcccacccagttccgctgcagcaatggctgctgcatcgacagtttcctggagtgtgacgacacccccaactgccccgacgcctccgacgaggctgcctgtgaaaaatacacgagtggctttgacgagctccagcgcatccatttccccagtgacaaagggcactgcgtggacctgccagacacaggactctgcaaggagagcatcccgcgctggtactacaaccccttcagcgaacactgcgcccgctttacctatggtggttgttacggcaacaagaacaactttgaggaagagcagcagtgcctcgagtcttgtcgcggcatctccaagaaggatgtgtttggcctgaggcgggaaatccccattcccagcacaggctctgtggagatggctgtcgcagtgttcctggtcatctgcattgtggtggtggtagccatcttgggttactgcttcttcaagaaccagagaaaggacttccacggacaccaccaccacccaccacccacccctgccagctccactgtctccactaccgaggacacggagcacctggtct

SEQ ID NO: 180143 - DNA, 512 bp, Homo sapiens
  Payload ID: 15486
  Gene Symbol: SPINT4
  Gene Name: serine peptidase inhibitor, Kunitz type 4
  Uniprot ID: Q6UDR6
  ENST ID: ENST00000279058
  CDS Start-End: 18-317
ctgctgcttgctgcaccatgaagtctgccaagctgggatttcttctaagattcttcatcttctgctcattgaataccctgttattgggtggtgttaataaaattgcggagaagatatgtggagacctcaaagatccctgcaaattggacatgaattttggaagctgctatgaagttcactttagatatttctacaacagaacctccaaaagatgtgaaacttttgtcttctccggctgtaatggcaaccttaacaacttcaagcttaaaatagaacgtgaagtagcctgtgttgcaaaatacaaaccaccgaggtgagaggatgtgaactcatgaagttgtctgctgcaccatccgaaataaagacacaagaaaattcagactgattttgaaatctttgtaatatttccataatgctttaagcttccatatgtttgctattttcctgaccctagttttgtctttcctggaaattaactgtatgatcattagaatgaaagagtctttctgtca

SEQ ID NO: 180144 - DNA, 1802 bp, Homo sapiens
  Payload ID: 15487
  Gene Symbol: SPINT2
  Gene Name: serine peptidase inhibitor, Kunitz type, 2
  Uniprot ID: O43291
  ENST ID: ENST00000301244
  CDS Start-End: 436-1194
gcggccgcgcaggtgcctgccctttgcgcctgcgcccagctcgccctgcctagccaggtgcgccccgccccctgcctgcccggccaccttcgggagccgcttccaataggcgttcgccattggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttctttatgggagtcctaatttcaaccctaccaaaatgatcacaagacactatctgaggtgtcccattctagaaatagacccctcaaaatagcgtctttcagatctttttgaatgaatccacaagatgaaataaatgtcctattactga

SEQ ID NO: 180145 - DNA, 1367 bp, Homo sapiens
  Payload ID: 15487
  Gene Symbol: SPINT2
  Gene Name: serine peptidase inhibitor, Kunitz type, 2
  Uniprot ID: O43291
  ENST ID: ENST00000454580
  CDS Start-End: 318-905
attggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaatttcagcatgtgctttc

SEQ ID NO: 180146 - DNA, 301 bp, Homo sapiens
  Payload ID: 15487
  Gene Symbol: SPINT2
  Gene Name: serine peptidase inhibitor, Kunitz type, 2
  ENST ID: ENST00000590510
  CDS Start-End: 145-301
ggtgcttggagacaacgtggccacctgggagtacggttcttgggcaagcgcctactgtgcgcccggcgccgttctacacaggaacacagcgcttttcaagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagca

SEQ ID NO: 180147 - DNA, 540 bp, Homo sapiens
  Payload ID: 15487
  Gene Symbol: SPINT2
  Gene Name: serine peptidase inhibitor, Kunitz type, 2
  ENST ID: ENST00000592007
  CDS Start-End: 354-540
agttccatggccaaagctcagggagaggccaggcctgtgagatggtgggggttgggttgggtgacctggtggccgttttagactcggaagaagcccatctcacccctgcctctttggagattggacaagagcctcccctgaagtttttgtagttgagttgcagtaaagtaggtgcccgagaaggagggagcaagaaaggaaacaagctttggggaagaggaagctctgctaaggctcgagagagtattggcgttgagcagctggtgttggggtctttggattggcccttagaagtcggtggtgaataagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtg

SEQ ID NO: 180148 - DNA, 749 bp, Homo sapiens
  Payload ID: 15487
  Gene Symbol: SPINT2
  Gene Name: serine peptidase inhibitor, Kunitz type, 2
  ENST ID: ENST00000587516
  CDS Start-End: 226-749
tgaggagcagacccaggcatcgcgcgccgagaaggccgggcgtccccacactgaaggtccggaaaggcgacttccgggggctttggcacctggcggaccctcccggagcgtcggcacctgaacgcgaggcgctccattgcgcgtgcgcgttgaggggcttcccgcacctgatcgcgagaccccaacggctggtggcgtcgcctgcgcgtctcggctgagctggccatggcgcagctgtgcgggctgaggcggagccgggcgtttctcgccctgctgggatcgctgctcctctctggggtcctggcggccgaccgagaacgcagcatccacgacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttgg

SEQ ID NO: 180149 - DNA, 1246 bp, Homo sapiens
  Payload ID: 15487
  Gene Symbol: SPINT2
  Gene Name: serine peptidase inhibitor, Kunitz type, 2
  ENST ID: ENST00000587090
  CDS Start-End: 193-801
attggctctggcgacctccgcgcgttgggaggtgtagcgcggctctgaacgcgctgagggccgttgagtgtcgcaggcggcgagggcgcgagtgaggagcagacccaggcatcgcgcgccgagaaggccgggcgtccccacactgaagacttctgcctggtgtcgaaggtggtgggcagatgccgggcctccatgcctaggtggtggtacaatgtcactgacggatcctgccagctgtttgtgtatgggggctgtgacggaaacagcaataattacctgaccaaggaggagtgcctcaagaaatgtgccactgtcacagagaatgccacgggtgacctggccaccagcaggaatgcagcggattcctctgtcccaagtgctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatagagggattgactcggatttgagtgatcattagggctgaggtctgtttctctgggaggtaggacggctgcttcctggtctggcagggatgggtttgctttggaaatcctctaggaggctcctcctcgcatggcctgcagtctggcagcagccccgagttgtttcctcgctgatcgatttctttcctccaggtagagttttctttgcttatgttgaattccattgcctcttttctcatcacagaagtgatgttggaatcgtttcttttgtttgtctgatttatggtttttttaagtataaacaaaagttttttattagcattctgaaagaaggaaagtaaaatgtacaagtttaataaaaaggggccttcccctttagaataaa

SEQ ID NO: 180150 - DNA, 383 bp, Homo sapiens
  Payload ID: 15487
  Gene Symbol: SPINT2
  Gene Name: serine peptidase inhibitor, Kunitz type, 2
  ENST ID: ENST00000587334
  CDS Start-End: 1-319
gagaggaactcctgcaataacttcatctatggaggctgccggggcaataagaacagctaccgctctgaggaggcctgcatgctccgctgcttccgctgtgtgttctcttccaggccagcaggagaatcctcccctgccccttggctcaaaggtggtggttctggcggggctgttcgtgatggtgttgatcctcttcctgggagcctccatggtctacctgatccgggtggcacggaggaaccaggagcgtgccctgcgcaccgtctggagctccggagatgacaaggagcagctggtgaagaacacatatgtcctgtgaccgccctgtcgccaagaggactggggaagggaggggagactatgtgtgagctttttttaaatag

SEQ ID NO: 180151 - DNA, 567 bp, Homo sapiens
  Payload ID: 15487
  Gene Symbol: SPINT2
  Gene Name: serine peptidase inhibitor, Kunitz type, 2
  ENST ID: ENST00000590738
  CDS Start-End: 1-392
ctcccagaaggcaggattctgaagaccactccagcgatatgttcaactatgaagaatactgcaccgccaacgcagtcactgggccttgccgtgcatccttcccacgctggtactttgacgtggagaggaactcctgcaataacttcatctatggaggctgccggggcaataagaacagctaccgctctgaggaggcctgcatgctccgctgcttccgccagcaggagaatcctcccctgccccttggctcaaagggtaagtggccccttaccctcctcctgccatcagcctgcctcctcccttccttgactgagctcagccctgcccagctgtggtttacattatccttcactgtgaacatcatcttggcagaaagtcatgtttctgcgtgagaatggcgaggtggtggtttgtcccaccgttcagtgtacacagttggggctggagtgagtcagtcacaaggcaggccctgcccaggcggcgtgggtgactggggatgaggtcttcctgttgagcatttgaggactgctgcacacgggcctgaggctggcctgaggtgtggaggga

SEQ ID NO: 180152 - DNA, 476 bp, Homo sapiens
  Payload ID: 15488
  Gene Symbol: SPINT3
  Gene Name: serine peptidase inhibitor, Kunitz type, 3
  Uniprot ID: P49223
  ENST ID: ENST00000217428
  CDS Start-End: 17-286
ctggctgagtggcaccatgcagcttcaggcctctctctcgtttctcctgattctcactctctgcctagagcttcgatcagaactagcacgagacactatcaaggatctcctcccaaatgtatgcgcttttcctatggaaaagggcccttgtcaaacctacatgacgcgatggtttttcaactttgaaactggtgaatgtgagttatttgcttacggaggctgcggaggcaacagcaacaactttttgaggaaagaaaaatgtgagaaattctgcaagttcacctgattttctaacaagaacacagccctccatggattcgggattgctctgagggccatagaaggcatttgcgtgtgtgtgtgtgtgtgtgtgtgaacaagaggttcattcctctacccccacatttattctccctgatgtgctcctacaagtgcttcatctctgtgcctgaaattctataaatgttgcaatcatg

SEQ ID NO: 180153 - DNA, 2728 bp, Homo sapiens
  Payload ID: 15489
  Gene Symbol: SRR
  Gene Name: serine racemase
  Uniprot ID: Q9GZT4
  ENST ID: ENST00000344595
  CDS Start-End: 319-1341
tccagcccttccgccatcttcgcggctgctgctacagccgtagcggctccgccaccgccgcgcgcagccaggaaaccaccacagacgggcggcgcgcgcgctcgcccacctcccggcctttccccgccccctgccgccctccctttccgaacgacggtggccgcgctgggaggaaaagcgcccgccgccggttccagaggggcgggaccggagcgagagcctgggtggggcgggcgggcgctgcgcgtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattcttaatggagagtggctatttcattaagatttaatagttttttttggactaagtagtggaaaaacttttatacttaactgagacattttgtcaaggctaaaaaaaagtcttgcaaaatggggcagtggactgacaggctgacatagaaaataaactttgcccaatcacaacttgtgcctcccatccctggagtactgactggcaccggtaagacagaatctctttgaatccattactccatgcccccttgaggcactgttgaagaaatctcacttttcagccagggtactggttctggtacatatggatcataagtccatttggggaagactcgtttatacaggttcatcagtactgtgtcttgagattttagcttcccatcaaagctgcatttcatgtggccatgggtacctagaaagacatcagaacaagtcggtcaaattaaaagtagaaaattttaaagcaatgacttccaacccaacagtcatttagcaacactgcagaaatgcagacatggtctcaaatcccgtgtttccttacctaaaggttccttgatatgtcctctccggccccacttcgttctcagttccactggtttaaaccacagcacatcctcttagaatcaaacacattaaagaccaagatgaaacatttacccacaaaatgtaaacccaacctttataccacaaaggcaatcagatcccatcctcctccttcatacccacctctgttgaagaacatgtaacgtactactgccatcttagtaaaaattttgaaaggatgaccactcagaacaactctcttgatgaccattctgtctggatctactgacataagatggcctgtagcaatgaggctgtgcattcctaaaggacaaaagcaaagaagctatttaggaatttacaggccaaagtcttcatttattgcccagtccatttaaagacccatgcaagagcctggtttgtcatccctgccctagcccaatctgaggctaagattggtaaactgtaagcccacacttaaccttgtcaataggttcttgaaaacttgtacttcaagagaaatgatgtataacaaaaccatactttttctcatcagttgttacaaggaaaggatgttgaacaaaaggcagttatttgaggactggctatacactgtttcacgtaaaagttggagttttcattgttctattaacaatgttaaatgaagacttactgtattttgaaaaccatcattaccttctccataccatttggctcccaaatttaaataaacaagagaaaacggtgttcatcta

SEQ ID NO: 180154 - DNA, 298 bp, Homo sapiens
  Payload ID: 15489
  Gene Symbol: SRR
  Gene Name: serine racemase
  ENST ID: ENST00000572709
  CDS Start-End: 100-298
ggcgagaaagagggtggaggcaggaattcgggccaggctctcccggagctggccaggactggccgagcccgaccccgcactaacccgcgagagagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagct

SEQ ID NO: 180155 - DNA, 586 bp, Homo sapiens
  Payload ID: 15489
  Gene Symbol: SRR
  Gene Name: serine racemase
  ENST ID: ENST00000570662
  CDS Start-End: 287-586
gaagattctcaaagaccagatgcccacttaactatggaaaagatatttgttggtggcattaacgaagacactgaagaatatcacctaagtgattattttgaacagtatggaaaaactgaagtgattgaaatcatgactgaccaaggcagtggcaagaaaaggggctttgcctttgtaacctttgatgatcatgactccgtggataagactgtcattcagaaataccatactgtgaatggccacaactgtgaaattaggaaaggcctgtcaaagcaagagatgaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaatt

SEQ ID NO: 180156 - DNA, 522 bp, Homo sapiens
  Payload ID: 15489
  Gene Symbol: SRR
  Gene Name: serine racemase
  ENST ID: ENST00000576620
  CDS Start-End: 73-522
gtgcgcagaggtgcggccggggaggcgcgcggaggctggagctggaggcgcggcgccggtgagctgagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccaagctgaaggggaaactgatgcccaatctttatcctccagaaaccata

SEQ ID NO: 180157 - DNA, 577 bp, Homo sapiens
  Payload ID: 15489
  Gene Symbol: SRR
  Gene Name: serine racemase
  ENST ID: ENST00000574987
  CDS Start-End: 344-577
gcagaggtgcggccggggaggcgcgcggaggctggagctggaggcgcggcgccggtgagctgagattcgtggtgctctcaatgccgtcagaagcttggttcctgatgctttagaaaggaagccgaaagctgttgttactcacagcagtggaaaccatggccaggctctcacctatgctgccaaattggaaggaattcctgcttatattgtggtgccccagacagctccagactgtaaaaaacttgcaatacaagcctacggagcgtcaattgtatactgtgaacctagtgatgagtccagagaaaatgttgcaaaaagagttacagaagaaacagaaggcatcatggtacatcccaaccaggagcctgcagtgatagctggacaagggacaattgccctggaagtgctgaaccaggttcctttggtggatgcactggtggtacctgtaggtggaggaggaatgcttgctggaatagcaattacagttaaggctctgaaacctagtgtgaaggtatatgctgctgaaccctcaaatgcagatgactgctaccagtccaagctgaaggggaaactgatg

SEQ ID NO: 180158 - DNA, 382 bp, Homo sapiens
  Payload ID: 15489
  Gene Symbol: SRR
  Gene Name: serine racemase
  ENST ID: ENST00000574229
  CDS Start-End: 184-382
aacttcgttcagcttttaagtcaactctcttttagggaaattctgacactccaataatggagaatttccacatgacaccacaggccccaggtctattctgttacgtattttcaaaatctcttcaataaacatactgtctcagactttgctttgacccctttcttattcctgggtttcagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagct

SEQ ID NO: 180159 - DNA, 566 bp, Homo sapiens
  Payload ID: 15489
  Gene Symbol: SRR
  Gene Name: serine racemase
  ENST ID: ENST00000575840
  CDS Start-End: 287-566
gtgcgcagaggtgcggccggggaggcgcgcggaggctggagctggaggcgcggcgccggtgagctgagtgacctcataccctggccactggtcctgggccaagatgggccagagtccttacccagaatttttttaactgaaactgagaaagaaaattccccttcagtgtggaagccataaaatgtaaaacatacgagctgtcagcagccacgtgtcagttggttccatatggaaccaactcgcctgtgtgaaaaagaagccgacgtgcagaaagcagcagagaaccatgtgtgctcagtattgcatctcctttgctgatgttgaaaaagctcatatcaacattcgagattctatccacctcacaccagtgctaacaagctccattttgaatcaactaacagggcgcaatcttttcttcaaatgtgaactcttccagaaaacaggatcttttaagattcgtggtgctctcaatgccgtcagaagcttggttcctgatgctttagaaaggaagccgaaagctgttgttactcacagcagtggaaaccatggccaggctctcacctatg

SEQ ID NO: 180160 - DNA, 588 bp, Homo sapiens
  Payload ID: 15489
  Gene Symbol: SRR
  Gene Name: serine racemase
  ENST ID: ENST00000576848
  CDS Start-End: 153-497
gtgcgcagaggtgcggccggggaggcgcgcggaggctggagctggaggcgcggcgccggtgagctgaggctctgaaacctagtgtgaaggtatatgctgctgaaccctcaaatgcagatgactgctaccagtccaagctgaaggggaaactgatgcccaatctttatcctccagaaaccatagcagatggtgtcaaatccagcattggcttgaacacctggcctattatcagggaccttgtggatgatatcttcactgtcacagaggatgaaattaagtgtgcaacccagctggtgtgggagaggatgaaactactcattgaacctacagctggtgttggagtggctgctgtgctgtctcaacattttcaaactgtttccccagaagtaaagaacatttgtattgtgctcagtggtggaaatgtagacttaacctcctccataacttgggtgaagcaggctgaaaggccagcttcttatcagtctgtttctgtttaatttacagaaaaggaaatggtgggaattcagtgtctttagatactgaagacattttgtttcctagtattgtcaactcttagttatcagattc

SEQ ID NO: 180161 - DNA, 3820 bp, Homo sapiens
  Payload ID: 15490
  Gene Symbol: STK39
  Gene Name: serine threonine kinase 39
  Uniprot ID: Q9UEW8
  ENST ID: ENST00000355999
  CDS Start-End: 707-2344
aaactagaaggactgcgattagattaggcaaggtgggaaagggataccggcaagtaaagcgccggaaacttacaacttgggttattttctaactggcgtcttgcaaagggacaccatgtaggtatcccgctcgtcaacttgtaaatgaacttcaggttctctttggtggcaggagaattctgaatgtgagaacctggcggccgttcaacgaccccgccctcggggtccccagggggcgtcctccggcaagcctgatcgtctggggccaaggcgcagggcgagcagggagggaggaggagaaccagggccggtggccccgaaagcacacacaaagcggcctgactcctttggtgggaacttccccggccgccagcggagcgggagcgggagggggcggcggagagggggggcggcggttcccctcgccgaggcggagaacagcgcgcgctaggctctgggcgcgcggcgagcgcagcggccgccgcctcctcccttccccgcctccgccggcgctgcctcctccctccgcccagctcggcctcccttgctccctcccctcctagctggcttcggcggggacggcggcggcggcggcgggcggggagggcgtgcgccggccgagaggtgtcggcggcgaggcaaaggaagtttcaagtggaaggtcgtccgtcggccggcgcgtcctcctgctctcctccgcagcatcatggcggagccgagcggctcgcccgtgcacgtccagcttccccagcaggcggccccggtgacagcggcggcggcggcggccccggcggccgcgacagcagcgccggccccggcagctcccgcggccccggccccggccccggccccggcggcacaggctgtcggctggcccatctgcagggacgcgtacgagctgcaggaggttatcggcagtggagctactgctgtggttcaggcagccctatgcaaacccaggcaagaacgtgtagcaataaaacggatcaacttggaaaaatgccagaccagtatggatgaactattaaaagaaattcaagccatgagtcagtgcagccatcccaacgtagtgacctattacacctcttttgtggtcaaagatgaactttggctggtcatgaaattactaagtggaggttcaatgttggatatcataaaatacattgtcaaccgaggagaacacaagaatggagttctggaagaggcaataatagcaacaattcttaaagaggttttggaaggcttagactatctacacagaaacggtcagattcacagggatttgaaagctggtaatattcttctgggtgaggatggttcagtacaaatagcagattttggggtaagtgcgttcctagcaacagggggtgatgttacccgaaataaagtaagaaaaacattcgttggcaccccatgttggatggctcctgaagtcatggaacaggtgagaggctatgacttcaaggctgacatgtggagttttggaataactgccattgaattagcaacaggagcagcgccttatcacaaatatcctcccatgaaagtgttaatgttgactttgcaaaatgatccacccactttggaaacaggggtagaggataaagaaatgatgaaaaagtacggcaagtcctttagaaaattactttcactgtgtcttcagaaagatccttccaaaaggcccacagcagcagaacttttaaaatgcaaattcttccagaaagccaagaacagagagtacctgattgagaagctgcttacaagaacaccagacatagcccaaagagccaaaaaggtaagaagagttcctgggtcaagtggtcaccttcataaaaccgaagacggggactgggagtggagtgacgacgagatggatgagaagagcgaagaagggaaagcagctttttctcaggaaaagtcacgaagagtaaaagaagaaaatccagagattgcagtgagtgccagcaccatccccgaacaaatacagtccctctctgtgcacgactctcagggcccacccaatgctaatgaagactacagagaagcttcttcttgtgccgtgaacctcgttttgagattaagaaactccagaaaggaacttaatgacatacgatttgagtttactccaggaagagatacagcagatggtgtatctcaggagctcttctctgctggcttggtggatggtcacgatgtagttatagtggctgctaatttacagaagattgtagatgatcccaaagctttaaaaacattgacatttaagttggcttctggctgtgatgggtcggagattcctgatgaagtgaagctgattgggtttgctcagttgagtgtcagctgatgtatgtcccttgatgtcaccctgatctgtcatgccccaccgccacccctactcccttcaaccctccctctttctgcccatttcctcccaccccctcactcccatttcctagcaaaatcagaagattgtgaagaggccggcttcaacaaaatgggataaaaaaataattttttaaaacttacaacactccgagttctgctttattctctagcaatccacagtacaagaacaagcaaatgccacagctgcacgactgttgctcatttttccaaaagctatttaatattcttagcaatcaatttggatatcccttaagtgaaaagaatctgaaatacactcaggtggtcttatttattggcaacaaaaggaattttctatccagaagcctatttctcctttcattgttgttatttctgttataatactttaattgtacatctgacaatactgcctcttttatgttgtatttagaaattaatatacttataaaattaagatttattagccaaacttgaattctagttttaaaactgactgtgaattttatttttcatatatttatgcattacacaccttagctataagaaaaaaagggttttgattatatgcttcttgcagttaatctcgttatttaaacaaaaagttttgggtctgtctttggagtatttgtaacttctaaattttgaaatgactgaattaggaatttggatgcttattcttttagtctgtttgcctaaaaaccaatttacaatctgactgtctcttgggagagggaggtgccttgcaaactttcacattaagaatgtgcctgaggctgctttactctggaatagtctcagatctaaaatttcctctatataaggtggcatatgttaagttttgcttcattggaccgtttagaatgctatgtaaaatgttgccattctgttagattgctaactatatacccatctctgatttggctctccttaagtgataggatttgttattctaaaggtgataaacttgaaaatatcagaatctgagttttacttgaaattttgcagaatacccaggtggagtgaaaattggaagggttttgtgcaatgactaaaaggtaaaacgctgttaaggttcaagaatcaatactttcaacccaagtagccctctgcttgactgtatattatggaactagtaaaccttaggattttgaaaattggagtctaatctttcaaggaggtgggctcccaggatggtaccattgctctttcctagctaaccctagatatggcagctctttaatgtacttcaaaaagcaaatatatattactaaggaaaaaaagttatttataattgccttgtcataattgttaaggtgttctagagccatttgcatacaatttaatgtaatttcattccattctattgtttacacaacgattactcgaagatgactgcaaaggtaaaaggaaaataaaagtgtattgcacaatgaga

SEQ ID NO: 180162 - DNA, 4011 bp, Homo sapiens
  Payload ID: 15491
  Gene Symbol: SRRM1
  Gene Name: serine/arginine repetitive matrix 1
  Uniprot ID: Q8IYB3
  ENST ID: ENST00000323848
  CDS Start-End: 316-3030
aaaggacttgcagggcggggcgactcgacggccttcccttttgctcccattggctgcggtcgtcaggttcgcctcctccactacctaccggggagtttagggcctgacagaagcccgcccccgctggcgctcgtgcgcacgcgtggcgggctctcggcgcactgagcaggcgcggcctcgtgtcggccggagggggcgggcgcaacgacgcgcgctgcgtcccggcgctcggctttccctccgccggtcccgccctccgtcgcggcggcgcggtgtaccctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaatttaaaaa

SEQ ID NO: 180163 - DNA, 3110 bp, Homo sapiens
  Payload ID: 15491
  Gene Symbol: SRRM1
  Gene Name: serine/arginine repetitive matrix 1
  ENST ID: ENST00000374389
  CDS Start-End: 29-2770
gggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttt

SEQ ID NO: 180164 - DNA, 3691 bp, Homo sapiens
  Payload ID: 15491
  Gene Symbol: SRRM1
  Gene Name: serine/arginine repetitive matrix 1
  ENST ID: ENST00000447431
  CDS Start-End: 6-2468
gcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatccgatcaagcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcaggtaaagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcgtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcaccccaaagaaggcagtccccgtctccaagtactaggcccattaggagagtctccaggactccggaacctaaaaagataaaaaaggctgcttccccaagcccacagtctgtaagaagggtctcatcctcccgatctgtctccgggtctcctgagccagcagctaaaaagcccccagcacctccatcccccgtccagtctcagtcaccgtctacaaactggtcaccagctgtaccggtcaaaggccaaaagcccaacaccgagcccatcaccgccaagaaattcagatcaggaaggaggtggaaagaaaaagaagaaaaagaaggacaagaaacacaaaaaggataagaagcacaagaagcacaaaaaacacaagaaggaaaaggctgtggctgcagctgctgcagctgctgtgacccctgcagccattgcagctgccacaaccacattagcacaggaagagccagtggcagcgccagagccgaagaaggagactgaaagtgaagctgaagataaccttgatgatttagaaaagcacctgcgtgaaaaggccctgagatcaatgaggaaggcccaagtgtccccacagtcttagggggaaatgtttgttatgatgtaaattttatttggtttgtacgcagttcaatttcaaaattgctaaaatgtgtttgagctttagactataacatttgttgtaataattgctaggttgaagttcaacatgtaaaaaaagggggcatggatttacattgcaaaaggtgtccacagtgtattagtgacattctttcattgacagctgacataattcattgagtgaaatattttaagccaaaaaaaaattccctttttaaaaaagggggtttaaatactgttggcatttttatggttcctttaaatgccctagctattcccagaggggtttttttgtttgtttttttggttttgattttctttttgtttttctttcttcttcttatttttttcatttgagtcttagctcccatttaagttatgcttctgaccttgtatggtctgtaagcttgcccagaaataagaccactgttttgaactaccacaaaagtataaatgaatattttaatgccacaatctttcctgttgcctgtggagtctctgctgaaatgaatcaggattcgagctctaggatgagacagaaaatgaaagcatgttgtttgccaggacactgtgggtttatattgatgtgtaacaagttgatttggaacactggactctcattctgttattctggttttgttttttttgttttgttttttttcttttgtaaaggcaatgagctagtcccagaaaggatccttcagttacatacaatttgtttaatgaaatgtcatggctctgttcatatttttgtcttgttcttccaattggtatatacaactttcagagcctcttgtatttggaaggctggaagggcccagactttggaatagtgtcttggtttcactgtttttgttttgattttttttttgttttgattttttttaaactaaagctatataaagcttgtggattaaacagaataaatttctaaattt

SEQ ID NO: 180165 - DNA, 563 bp, Homo sapiens
  Payload ID: 15491
  Gene Symbol: SRRM1
  Gene Name: serine/arginine repetitive matrix 1
  ENST ID: ENST00000593639
  CDS Start-End: 259-563
gaatcgcttgaacccgggaggcagaggttgtagtgagccgagatcgcgccactgcacttcagcctgggcgacagagcgagactcggtctcaaaaaaaaaaaaaaaagatatctggaagtagagcattctagattacatcaaagacgaaatagcgtgcatcagggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaact

SEQ ID NO: 180166 - DNA, 2314 bp, Homo sapiens
  Payload ID: 15491
  Gene Symbol: SRRM1
  Gene Name: serine/arginine repetitive matrix 1
  ENST ID: ENST00000596378
  CDS Start-End: 271-2314
acgcggcggcgacggtggccggaaaatggcggcgggaatgggccgggatggtacctcgctgcccgcctgcctggcggggcctgcaggccgagcgccgtgcgtgccgccgggtcctggggcctagcggagccggaggaggaagtcccgagtgggaggccaaaggaaagccctaagggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaagaatccagactccaaaatgatgcaaatcaacctgactggatttttgaatggaaaaaatgctcgagaatttatgggagaactgtggcccctgctgctaagtgcacaagaaaacatcgcgggaatcccttctgctttcctagaactgaagaaagaagaaataaaacaaagacagattgaacaagaaaaactggcatctatgaaaaagcaagatgaagacaaagataaaagagataaggaagaaaaagaaagcagcagagaaaaaagggagcggtctcgtagcccaagaagacgcaaatccagatctccttcccctagaagacgatcttcccctgtcaggagagagagaaagcgcagtcattctcgatctccccgtcacagaaccaagagccggagtccttcccctgctccagaaaagaaggaaaaaactccagagctcccagaaccttcagtgaaagtaaaagaaccttcagtacaagaggctacttctactagtgacattctgaaagttcccaaacctgaacctataccagagcctaaagaaccttctccggaaaaaaattccaaaaaagaaaaggagaaggagaagacccgaccacgatctcggtcacgctccaaatcaagatcccggacgcggtcccgctctccttctcacactcgacctagacggcgccatagatcccgatcaagatcgtattcacctagaaggcggccaagcccaagaaggcggccatctcctcgaagaagaactccgccaagaagaatgcctcctccaccaaggcatagaaggagtagatctccagtaagacgaagaagacgttcgtcagcatccttgtctgggagtagctcatcatcctcttcatctcgttcacggtcaccaccaaagaagcctcccaagaggacatccagcccccctcggaaaactcgtaggttatctccttcagcaagtcctccaaggcgaaggcacaggccatcacctcctgcaactccaccacccaaaactcggcattcccctacaccccagcagtcaaaccgtacaagaaaaagtcgtgtttctgtgtctccagggagaacttcagtgacaaaacataaaggtactgagaaaagagaatccccttcaccagcaccgaagcctagaaaagtagagttatctgaatcggaagaagataaaggtggcaaaatggctgcagcagattctgtgcagcagagacgccaatacagacgacaaaaccagcagtcttcatctgactctggctcctcctcctcctcagaagatgaacgacccaagagatcccatgtgaagaatggtgaggttggcaggcggcggagacattccccttcccggagtgcttctccatcaccacgaaagcgccaaaaagagacttcccctcggatgcagatgggaaagcgatggcaatcgccagtgactaaaagtggtagacggaggagaagtccatccccaccacccaccagaaggcgacggtctccttctcccgcccctcctcctcgacggcgcaggactcccacaccaccaccacgacgaaggactccttctcctcccccacgtcggcgctcaccttctcctagaagatactctcctccaatacagaggagatactctccttctccacctccaaagagaagaacggcttcacctcctccccctcctaaacgaagagcatcaccatctccaccaccaaagcggcgggtctcccattctccacctcccaaacaaagaagctccccagtcaccaagagacgttcaccttcattatcatccaagcataggaaagggtcttccccaagccgctctacccgggaggcccgatcaccacaaccaaacaaacggcattcgccctcaccacggcctcgagctcctcagacctcctcaagtcctccacccgttcgaagaggagcgtcgtcatcacccc

SEQ ID NO: 180167 - DNA, 575 bp, Homo sapiens
  Payload ID: 15491
  Gene Symbol: SRRM1
  Gene Name: serine/arginine repetitive matrix 1
  ENST ID: ENST00000600523
  CDS Start-End: 40-279
accctgggatagggagcgatctccgagcgaggcggcaagatggacgcgggatttttccgcggaacaagtgcagaacaggataatcggttcagcaacaaacagaagaaactactgaagcagctgaaatttgcagaatgcctagaaaaaaaggtggacatgagcaaagtaaatttggaggttataaagccttggataacaaaaagagtaacggaaatccttgggtttgaagatgatgttgtgattgagtttatattcaaccagctggaagtgaaggcctgaaccaaaatggaagttattccttgcgtctgaagtatagcaccatcaccttattaggtcacagcagagtgagtgtcccaatgtcgctctgacccaactcccttgatgatgcagtgtgtgtttggagataaatgatataacattaaactcaaggtggttgagttgcagtagggagtcggaagcaagccaagggaacatctttctctacaggggacttggcgattccaaacccccaaggttccaagaagaaactgaagacacctggaatctaatccagactccaaaatgatgcaaatcaa

SEQ ID NO: 180168 - DNA, 9353 bp, Homo sapiens
  Payload ID: 15492
  Gene Symbol: SRRM2
  Gene Name: serine/arginine repetitive matrix 2
  Uniprot ID: Q9UQ35
  ENST ID: ENST00000301740
  CDS Start-End: 550-8808
agaatgctctgcatcgacagcgggagacgagacgcgctcgggcgtcgctttgctgccgctaggccctgtgctcctccccgcagcggaaggcctacgaatacgcggtgtcttacgtcgcttcctccgttcttcgttgcactggccaacgggacgcttagtctttcggcaacggggtgaaaccttccttgtgcctgaaaaaacggtacttcgcggtgtggcttcggcgcctgcgcaaaaggccgcggggcgcactccagttcccggcaggccccgcgacgcgcgtttgcgtgctgacgcacgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaagagaagtctaaagactcactagttcaaagttgccctggatccctctctctctgtgcaggagtaaaatctagcacaccaccaggcgagagctattttggtgtctcatctctgcaactgaaaggacaatctcaaacttcaccagaccacagatctgatacttcaagtccagaagtgagacagagtcattcagaatcaccatctctgcagagcaaatctcaaacatcacctaagggaggtcggtccaggtcttcatctccagtcactgagctggcatccagatctccaataagacaagatagaggtgagttctcagcgagtcctatgttgaaatctggaatgtctcctgagcagagcaggttccagtctgactcttcttcatatcctacagtggactcgaattctctcttggggcagagtagattggagactgctgaatcaaaagagaaaatggccttaccccctcaggaggatgctactgcatcacctcctagacagaaagacaaatttagtccctttccagtacaggataggcctgagtcttcactggtattcaaagacacacttagaaccccgccaagggaaagaagtggtgctgggtcatctccagaaacaaaagagcaaaatagtgcattgcctacgtcaagccaagatgaagagttaatggaggtggtagagaagtctgaagaacccgcaggccaaatcctgtctcatttgtcttcagaacttaaagaaatgtccacaagtaactttgaatcatctcctgaagtagaagaaaggcctgctgtgtctttgactcttgatcagagccagtcacaggcttctttggaagcagtagaagtcccttcaatggcctcatcttggggtgggccacatttttctccagaacataaagaactgtctaactccccactcagggagaacagctttggatcacctttagaatttagaaactcaggcccacttggtacagaaatgaatactggattttcttctgaggttaaagaagatttgaatggaccgtttcttaatcagctggaaacagatccatctctagacatgaaagaacaatcgacaagatcctctggacacagcagttctgagttatccccagatgcagtggaaaaggcagggatgtcttcaaatcagagcatctcttcacctgtgcttgatgctgtacccagaacaccctcgagagaaagaagtagttctgcatcttctcctgaaatgaaagatggtttacccagaactccatcaaggagaagcaggtctgggtcttctccaggacttagagatgggtctgggactccctcgaggcacagcctgtctgggtcctctcctggaatgaaagatatacctagaacgccatctagagggagaagcgaatgtgattcttccccagaaccgaaagctttgcctcagactcctaggccgaggagtcgttctccatcatccccagagctcaacaacaagtgtcttaccccccagagagaaagaagcgggtcagaatcatcagttgatcagaaaactgtggctcggactcccctggggcagagaagtcgttcgggatcctctcaagaacttgatgtgaaacccagtgcatcccctcaggaaagaagtgagtcagactcttctccagattctaaagccaagacaagaaccccacttcggcagaggagtcggtctggatcatctccagaggttgacagcaaatctcgactatcccctcggcgcagtaggtctggttcctcccctgaagtgaaagataagccaagagcagcacccagggcacagagtggttctgattcctctcctgaacctaaagctccagcccctcgggcccttcccagacgaagcagatcaggttcatcaagcaaaggcagaggcccttctcctgaaggaagcagcagtaccgagtcctctcctgaacatccgcccaaatccagaactgctcgcagaggttccaggtcatcaccagagcccaagaccaagtctcgtacaccacctcgacgtcgcagctctcgatcatctccggagctaacaaggaaggccagactgtcccgtagaagccgctctgcctcatcctcaccagaaactcgctctagaactcccccaaggcaccggagaagtccctcagtgtcttccccggagccagccgaaaaatcgaggtcttcacgccgacggcgctcagcttcatctccacgcactaagacaacctcaaggagaggccgctctccttcgccaaagcctcgtggactccagaggtcccgttcccgctcaaggagagagaaaacaagaacaacccgacgtcgagataggtctggatcttctcagtcaacctctcggcgaagacagcggagccggtcaaggtcgcgggttactcggcggcggaggggaggctctggttatcactcaaggtcacctgcccggcaggaaagttcccggacctcctctcgacgccgaagaggccgctctcggacacccccaaccagtcggaagcgttctcgctcacgcacatcaccagccccgtggaaacgctctagatctcgagcctctccagccactcaccggcgatccaggtccagaacccccctgataagccgacgtaggtccagatctcgaacttcaccagtcagccggagacggtcaaggtccaggacttcagtgactcgacgaagatcccggtcaagagcatccccagtgagcagaaggcgatccagatccagaacgccaccagtaacccgccgtcgttcaaggtctagaacgccaacaacacgccgccgctcccgttctagaactccaccagtgactcgcagaaggtccagatccaggactccaccagtaaccaggaggcgatctcgaagcagaacttcgcctatcactcgcagaagatcaagatccagaacatctccggtcacccgaaggagatctcgatctcgcacatctccagtaactcgaagaaggtcccgctctcgaacctcaccagtgacacgccgccgctctaggtcccggacacctccagctattcggcgccgctctagatctcgaacgccactgttaccacgcaaacgttctcgaagtcgctcaccacttgctatccgccgccgctccagatcccgtactccacgaacagctcggggtaaacggtccttaacaagatctcctccagccatccgcaggcgttctgcatctggaagtagttctgatcgttcacgatctgctactcctccagcaacaagaaatcattctggttcacggacacctccagtagcactcaacagttccagaatgagctgcttcagtcgtcctagcatgtccccaacacctcttgatcgctgcagatcacctggaatgcttgaaccccttggcagctctagaacacccatgtctgtcctgcagcaagccggcggctccatgatggatggtccaggtccccgaatacctgaccaccagagaacatctgtgccagaaaatcatgctcagtccaggattgcacttgccctgacagctatcagtcttggcaccgctcggcctcctccgtccatgtctgctgctggccttgctgcaagaatgtcccaggttccagccccggtgcctctcatgagtctcagaaccgcaccagcagccaaccttgccagcaggattcctgcagcctctgcggcagccatgaacctagccagcgccaggacacctgccattccaacagcagtgaacctggctgactctcgaacgccagctgcagcagcggccatgaacttggccagccccagaacagcggtggcaccttcggctgtgaacctggctgaccctcgcactcccacagccccagctgtgaacctagcaggggccagaaccccagctgccttggcagctctgagtctcacaggctctggcacaccaccaactgctgcaaactatccctccagctccagaacaccacaggctccagcctctgcaaacctggtgggtcctcggtctgcacatgccacagctcctgtgaatattgccggctccagaaccgccgcagccttggcccccgcgagcctcaccagtgctaggatggctccagcattgtctggtgcaaacctcaccagccccagggtgcccctttctgcctacgagcgtgtcagtggcagaacctcaccaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacctgcaagccccaagaagccaccccctggcgagcggaggtcccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctccgtgagttcttcctggttcatgtgttctggggggtttggggtgggagggaatgcagatgggagttgggggaggggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaa

SEQ ID NO: 180169 - DNA, 579 bp, Homo sapiens
  Payload ID: 15492
  Gene Symbol: SRRM2
  Gene Name: serine/arginine repetitive matrix 2
  ENST ID: ENST00000574340
  CDS Start-End: 235-579
tttgagttgttagtggcggggagaaaccccaaatcttaaaaactgtgaagaaagtgaacgtgttcagtttacatttgtaaggtagaccgtgcgttccctttttacactttttcaacgtctcccgagaattcgtgttcaaactaaggaggcttttggagaccttcgttgggaagaaaacgccagactcatatataagttttctggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagagg

SEQ ID NO: 180170 - DNA, 2870 bp, Homo sapiens
  Payload ID: 15492
  Gene Symbol: SRRM2
  Gene Name: serine/arginine repetitive matrix 2
  ENST ID: ENST00000571378
  CDS Start-End: 186-2870
ggcgtcggcgtcggctgaggcgggcggaccggcgaggcgaggcggcggccccaggcccgagggactcgggagctcgagcagcggcggcggcaagacctctccccctcggaggcggcgggcggaggcggcgggtgagagggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcaggg

SEQ ID NO: 180171 - DNA, 461 bp, Homo sapiens
  Payload ID: 15492
  Gene Symbol: SRRM2
  Gene Name: serine/arginine repetitive matrix 2
  ENST ID: ENST00000576415
  CDS Start-End: 180-461
gaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaag

SEQ ID NO: 180172 - DNA, 1146 bp, Homo sapiens
  Payload ID: 15492
  Gene Symbol: SRRM2
  Gene Name: serine/arginine repetitive matrix 2
  ENST ID: ENST00000575009
  CDS Start-End: 256-1146
gtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaacccc

SEQ ID NO: 180173 - DNA, 431 bp, Homo sapiens
  Payload ID: 15492
  Gene Symbol: SRRM2
  Gene Name: serine/arginine repetitive matrix 2
  ENST ID: ENST00000570539
  CDS Start-End: 1-126
caaggagtgtcccttcttccccagcagagccgtgggagggtccttgtctgctctcctttgaaccttggcagcccttggatggagggctccctttccctccccttttttttttctttgttcctgtgaaatgttaatctccgggaggatacagttcaggataccccagcctggagtcagggccagggaggcatggccccacttgtatccagaagttcccaggggtgattgtgatggtggttgggactggaggttgtataaggtgttcttggaaggaaggggcaggagttggaattagttggtccctactgtcccccatgaggttgtgaacccctccccccaacttttcatgtttcttaaaggcattttggttttttaaaatctgtacagcaagagcaactttttctgtcaaataaaaatgagaaatgcaggaa

SEQ ID NO: 180174 - DNA, 887 bp, Homo sapiens
  Payload ID: 15492
  Gene Symbol: SRRM2
  Gene Name: serine/arginine repetitive matrix 2
  ENST ID: ENST00000572883
  CDS Start-End: 1-553
accaccgctccttgaccgagctaggtccagaacaccaccgtctgccccaagccaatctaggatgacctctgaacgggctccctccccttcctctagaatgggccaggctccttcacagtctcttctccctccagcacaggatcagccgaggtctcctgtgccttctgctttttcagaccaatcccgttgtttgattgcccagaccacccctgtagcagggtctcagtccctttcctctggggcagtggcaacgaccacgtcctctgctggtgatcacaatggcatgctctctgtccctgcccctggggtgccccactctgatgtgggggagccacctgcctctactggggcccagcagccttctgcattagccgccctgcagccagcaaaggagcggcggagttcctcctcgtcgtcgtcgtcctctagctcctcctcttcttcatcatcgtcgtcgtcgtcctcctcctcctctggctccagttctagtgactcagagggctctagccttcctgtgcaacctgaggtggcactgaagagaggacagaactagaggaaatggacttaattttacagcaggagggatggcagttagacctcaagaggaactccctgggctggaaggatcttcagagggtccccagccccaccccagccccaaaggaggctgttcgagagggacgtcctccggagccaaccccagccaaacggaagaggcgctctagcagttccagttccagctcctcctcttcatcttcctcctcctcctcctcctcctcttcttcctcctcctcttcctcttcttcttcttcctcctcatcttcctcctcctcgtcgtcttcctccccttcccctgctaagcctggccctcaggccttgcccaaacc

SEQ ID NO: 180175 - DNA, 3314 bp, Homo sapiens
  Payload ID: 15492
  Gene Symbol: SRRM2
  Gene Name: serine/arginine repetitive matrix 2
  ENST ID: ENST00000576924
  CDS Start-End: 261-3314
acgcagttagtcgtgctgacgtgcagcgcggcccaggcggggtgcgagtggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtgagagggagcggtggtgccccccccgggcacggggccatgtacaacgggatcgggctgccgacgccccggggcagcggcaccaacggctacgtccagcgcaacctgtccctggtgcggggccgccggggtgagcggcctgactacaagggagaggaggaactgcggcgcctggaggctgccctggtgaagcggcctaatcctgacatcctggaccacgagcgcaagcggcgcgtcgagctgcgatgcctcgagctggaggagatgatggaagagcaggggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaaccccccatctgaggcctctccaactcgggaccgttcaccacctaagtctcccgagaaacttccccagtcttcttcctcagagagcagcccaccatcccctcaacctaccaaagtttctcggcatgccagctcttccccagaaagtcctaaacctgctccagctccagggtcccaccgagagatttcttcttctcccacatctaagaatcgctcacatggccgagcaaaacgggataaatcacattctcataccccctcccgtaggatggggaggtcccgtagccctgccaccgctaagagagggcgatctcggtctcgaacccctaccaagagaggtcattctcgatcccgatctccccagtggcgtaggtccaggtctgcacagaggtggggaagatctagaagcccccagcgacgtggccgctctaggtctcctcagcgaccaggctggtctaggagcagaaatacccagagaagaggcaggtctaggtcagcaaggcgagggaggtcccactctagatccccagccactaggggtagatctcgttctagaacaccagcccgccggggcaggtcccgctctagaacacctgccaggcggagatcacgatccagaactcccaccaggcgtaggtctcggtctagaacaccagcccggaggggcaggtctcggtctagaacacctgctaggcgcagatctaggacccgatcaccagtacgacgcaggtctcgtagtagatcaccagccaggagaagtggcaggtcacgctctagaaccccagctagacgtggccgctcacgctccagaaccccagccagacgtggccgctcacgctctagaaccccagctagacgcagtggtcgctcacgctccagaacaccagccaggagagggaggtctcggtctaggacaccaagacgaggaagatcccgcagtagaagcttagttagacgtggaagatctcactctagaacacctcaaagaagaggcagatctggctcatcttcagagcggaaaaacaaatccagaacatctcaaagaagaagcaggtccaattcaagcccagaaatgaagaaatctcgcatttcttcaaggcggagcaggtctctctcttcaccacggtccaaagcaaaatctcgcttgtctttgaggcgcagcctttcagggtcttccccatgccctaaacaaaagtcacagacaccacccaggcgcagtcgctctggatcctcccaacctaaagctaaatctagaacgccacccagacgcagtcgctccagttcttctccgccacctaaacagaaatctaagacaccatcaagacaaagtcattccagttcatctcctcatcctaaagtgaaatctggaacaccaccgaggcaagggtccataacaagtccccaggccaatgagcaatctgtaacgccacagagacggagctgttttgaatcatcacctgaccctgagttgaaatctaggaccccttctagacatagctgctcagggtcctctcctcctagagtgaaatctagcacacctcccagacagagcccatctaggtcatcatctccacaacccaaagtgaaggcaataatatcaccaagacaaagaagccattctggctcctcttctccaagtcctagtagggtgacgtcgagaacaactccacggcgaagcagatcagtatctccctgctccaatgtggaatccagattgttgccaagatacagtcattctgggtcctcctcaccagataccaaagtgaaacctgaaacaccgccaagacaaagtcactcagggtctatttcaccataccccaaagtaaaggcccaaactccaccggggccaagtctttctggatcaaagtcaccatgtccccaa

SEQ ID NO: 180176 - DNA, 459 bp, Homo sapiens
  Payload ID: 15492
  Gene Symbol: SRRM2
  Gene Name: serine/arginine repetitive matrix 2
  ENST ID: ENST00000573692
  CDS Start-End: 1-235
ccgcagcccccggaagccaatagactccctcagggactctcggtccctcagctactcgcctgtggagcgtcgccgtccctcgccccagccctcaccacgggaccagcagagcagcagcagtgagcggggttcccggagaggccagcgtggggacagccgctcccccagccacaagcgcaggagggagacacctagccctcggcccatgagacaccgctcctccaggtctccataaattgtctttgggggattccaccacacccaatgctctggagccacaaggagtgtcccttcttccccagcagagccgtgggagggtccttgtctgctctcctttgaaccttggcagcccttggatggagggctccctttccctccccttttttttttctttgttcctgtgaaatgttaatctcccaagagcaactttttctgtcaaataaaaatgagaaatgcagg

SEQ ID NO: 180177 - DNA, 1132 bp, Homo sapiens
  Payload ID: 15492
  Gene Symbol: SRRM2
  Gene Name: serine/arginine repetitive matrix 2
  ENST ID: ENST00000570971
  CDS Start-End: 43-798
gaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggaggtatgttcctgagttggtgatgttcattggattgcaaatgtatagatttaggatagacatgtgatgtgaaagggagaggtaataacttattaaaataaataaattcagttttttttcctgcatttctctcctagttctcttactgcatctgcagaacttttagtgttgttactagactgaattgtgaaccctttagaatcaaatctcactggatgttaggttttatattgtgtcttgtttatacatagatagaactggaacaaacgttgtatcttatctgtgtactccgtatgatgcctctagtttcttctcttttttcattaaatgctggtcatgtctcaccaaa

SEQ ID NO: 180178 - DNA, 1207 bp, Homo sapiens
  Payload ID: 15492
  Gene Symbol: SRRM2
  Gene Name: serine/arginine repetitive matrix 2
  Uniprot ID: Q9UQ35
  ENST ID: ENST00000630499
  CDS Start-End: 219-1154
ggcgcagttggagcccgttgcggcccctgaggaagcgaggaggcgtcggcgtcggctgaggcgggcggaccggcgaggcgaggcggcggccccaggcccgagggactcgggagctcgagcagcggcggcggcaagacctctccccctcggaggcggcgggcggaggcggcgggtacgaggaacagcaaattcaggaaaaagtggcgacctttcgactcatgttgctggagaaggatgtgaaccctgggggcaaggaggagaccccagggcagaggccagcggtcacggagactcaccagttggcagaattaaatgagaagaagaatgaaagactccgtgctgcctttggcatcagtgattcttacgtagatggcagctcttttgatcctcagcgtcgtgcccgagaagctaaacaaccagctcctgagcctcccaaaccttacagccttgttcgggagtctagcagttctcgctcaccaaccccaaagcagaagaagaagaaaaagaagaaagatagaggacgcaggtcagagagcagctctcctcgacgggagagaaagaaaagctcaaagaagaagaagcacaggtcagaatctgagtccaagaaacgtaagcataggtctcccactccaaagagcaaacgtaaatctaaggacaaaaagcgaaagcggtctcgaagtacaacaccagcccccaagagccgccgggcccaccgttcaacttctgctgactctgcttcctcctccgatacttcccgcagtcggtctcgaagtgctgcagctaaaactcatacaactgccttggctgggcgaagtccttcccctgcttcagggcgacgcggggagggagatgcgcctttcagtgaaccaggtactaccagcacacaacggcctagtagcccggagactgctacgaaacagcctagcagcccttatgaagacaaagataaagacaagaaggagaaatctgcaactcgacctagcccctctccggaaaggagcagcacaggcccagaaccacctgctcccactccgctccttgctgagcgacatggcggctccccacaaccccttgcaaccacccccttaagccaggagccagtgaacccctccccccaacttttcatgtttcttaaaggcattttggttttttaaaatctgtacagcaagagcaactttttctgtcaaataaaaatgagaaatgcagg

SEQ ID NO: 180179 - DNA, 3612 bp, Homo sapiens
  Payload ID: 15493
  Gene Symbol: SRRM3
  Gene Name: serine/arginine repetitive matrix 3
  ENST ID: ENST00000611745
  CDS Start-End: 208-2169
agcatttcagcaagcggcggcagcacccgcggggaggcagagggtgcggggccgtgggggccgcggagctgccctgcccaactcagcccagactaggcggcagcccggaccggcgggacccgagggcctggccccagcgcccggtagatcgcggcggtcagcggtgagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacattgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctccaagtgcaaaagaaaagagaagaacaaagagaagaagaggcctcacacagagtccccaggccggaggtctcatcgccatagcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgataagcccagctcgccctcgcccagggtccgtgacaaggcggcggccgccgcacccacgccgcccgcgcgggggaaggagagcccgagcccgcgctcggcgccgtcgtcccaaggtcgcggaggccgcgcggcgggcggggcgggcaggcggcggcggcggcggcgtaggcggcggcgctcgcggtcctcggcgtccgcgccccgccgcaggggtcgccggcgcccccggcccgcgcccccccggggctcgtcgcgctcgctcagcagggcccgctccagcagcgactccggcagcggccgcggcgcccccggccccgggcccgagcccggctctgagcgaggccacggcggacacgggaaacgggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccagcgcccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccgg

SEQ ID NO: 180180 - DNA, 2797 bp, Homo sapiens
  Payload ID: 15493
  Gene Symbol: SRRM3
  Gene Name: serine/arginine repetitive matrix 3
  ENST ID: ENST00000464752
  CDS Start-End: 1-330
agtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgatgtacgtacgcttcgctttgcggagggttcccgcgccgcgggctgcgccgtgcgtggtcgggcgggtcgccagcggggcagggggcgataagtgtggcatgggggcgggggcgggggcggccgcttcctccctcctcggctccccgctgggcgtcctggctcgggagccgccgggagtgctaggccgttgcgcccacctggccctggtgtcagggtgaggggcgcctgcggtcttgggccacccttgcgcttggcaaactgaaggccagaggggggttgaccgcggggcactgagttgggtacagggctggggaggaatcagggtctcgtgccctccccaggcatattagggtgggaggggcatggacattgataggagtcccaggcaggagcaggattcgagagacaggaccccccactgggcaccacctgggccctgagtctccctcttcccaccaagccctggccccacctctgagcacccccctccccctccctcaatcttctccccagcccctccctccctcagccccctcccccatctcagtccctctgccctctaaagtccctgctctgaggagactctgcccttttccaggcaccgcccacacttggactggtgtctcaaacctgccggctcctcttcccacggccaccctcctgaggcacctgccagcgtgcctcagagaccccacaccaacacccccaaaactgtccccacccttcctccaagaggggcacagatgcccgaagacctacaggcaggtgcaatgggggagctggcagaggagagagacgtctcagcctgtccccagatggatgggctgggcctgggttggggcttctcccagaccccagggaaggtccacatccccttctggtctgttgattatagagtacacagttgagacccctcagagagagggggctgcagtgctggcaggggcactggggtgggtgggggggtggcttggggtggggagacctgcaggttccttcccagacccgcagactgccccccacccaaccccaaagcctcagctgggagtgggagagctgcccctccccagacctcaggtctcagcagcaaacatgtacgtgttggtcagtttcattttgatttttggctgtttcctttcactccctttcttttctcaaacaccctttactcccacggcctcagagaggaaagtcaagggcagctgactgaaggctcttggtctcaaggttaagttttattgaaggacatttacctgtctctagactgtcccacctggaccaggcaccaggctcctgggctctgggggttttggttgggccgcgcagggaggatgacactgatgtccccggatctgtcttgggagggggttgagggcaggcagaggtagctgagggtagcatggcagaggctggagaggattaacaacccacaagaggggcacccaccatcccccacccctgtgggcatggagtcccaagagcacaggacccgaaacaccttcttgccagcttctcatccacccttctggggcctcccaagagacacagagatgcgggttctctgaagtcagggctggaagtgggtcccttcgtacctctggtcctctctccagccctggagtcctgagcaatgatcccacctccaccccctccccaatgcagacaaaatggccacagcatctaggcatccccaggatagggcagtcggggaaggggacccagccaccagccttggggcgggagcttctgaagcacccacatcttgtctccctcccagcatgggactctagtttggcacagccctgggagttttcttggagacggcattttgtgactcctttcaccaagcatggtccccaaatcctatccctcacccttggggccctgggagatctgggacttcagagcatcccgggtctcaaacctgcattcagatccctgcctctctgccttaaaaagacccctgaggagtcaaaagaggctagttcttgctcatatgcagaaaagtgagatgggggatgggagaggggtcccagactttaccatgaacgaaaccgtcttcgggaaaaaatactgggggtggtattcttggacgatacctttaaaaaaaaaaagaaaagaaaaaaagagagagagaaacaaatggaaaaaaaggaaagctcaacattttttaaccccgtctatgtttttgtttgttttttagcctcccatttgaaacgtggtaatactgtgattccatttcttgtttagctggtgagggaagagggtgggcaagtttatgtaactttttctgttgttttgtttttatttccttttcctttctttttttttttccctattttaatgtacagaaatgcaaactatctctctgggttttttttttctatcttctatgttctagaattttctttttgtgtgtgttactgtgggaacctttcctcttaatgcagagatggcttttgaattttaagtgaacattaatcatatacacatctctatatacttttttttcctttgtaatctgaatttaaaagggaagataactctaaaaaaaaaaa

SEQ ID NO: 180181 - DNA, 8477 bp, Homo sapiens
  Payload ID: 15494
  Gene Symbol: SRRM4
  Gene Name: serine/arginine repetitive matrix 4
  Uniprot ID: A7MD48
  ENST ID: ENST00000267260
  CDS Start-End: 389-2224
gtcacattgtgcgagagacaaaacccgggcgcgccggagctcacacgcgcacgcacacacatccgaccccgtcgcctcttctctcctggtgctgcccagaaagccagccctcccttcccttcttggggcgcagaggctcagccagctcagagcgcagcctggagccgacccagaagggcgaagaaagcccagcggacgagcctcctttctctgctgcctgcccgggctggggcgtcccatcccccgccctgaactccgatctctcccaccccacccctctctgggtttcacccggacagagccgggagctgggtgtcgcccccgtttggaatccacgtttcagcactttggacagcgccccggacgccccggcccctttgggttggcgatggcgagcgttcagcaaggcgagaagcagctttttgagaagttctggcgaggaaccttcaaagcggtggccaccccccgtcccgagagcatcattgtcgccagtatcacggcccgcaagccgctgccaaggacagagccccagaataaccccgttgtcccagctcaggatggaccctcagaaaagctgggtcagcatctggccaccgagcccttgggcaccaacagttgggagagagacaagacctgtcgggaactgggtgccaccagaggacacagtgcctctcatgacaaagacttgacaccaccaccttcctccaggggaaagaagaaaaagaagaaatccactcggaagaagagaaggaggtcctcatcctatagcccatcgcctgtcaagaaaaagaagaagaaaagttccaagaaacacaagcgacgcaggtcattctccaagaagagaaggcacagctcctctagcccaaaaagcaaaagaagagatgagaagaggcacaagaaacaatctcgaagccggccccgaaagtctcaccgccaccgccatcaccgctgcccctcgcggtcccagagctcggagtcccgcccctcaagctgtgagagcaggcaccgcggccggtcccctgaggaagggcagaagtcccgccgaaggcactcccgccgctgctccaagaccctctgcaaggacagccctgaggcccagtccagtcgcccgcccagtcaacccctccagatgcttggctacctgtcagccaggggtgtaatcactgggtcggggtctgctgctgacctctttaccaaaacagccagcccgctcaccacctcgcgaggacgttcccaggagtacgactcaggaaatgacacgtcctcgccaccctccacgcaaaccagctcagccaggtctcggggccaggagaaggggagccccagtgggggcttgagcaagagccgggagctcaacagtggcaacacctctgattcagggaactccttcaccacctcctcaccccagaacaagggggccatgttggagaatctctcccccaccagcaggggcagagagtcaaggggatttcagtcaccgtgtctggaatgtgccgaagtgaagaagtccagtttggtcccatccacagcccggagctcacccatgaaagggtgttcccgcagctcctcctatgccagcacccgatcctccagtcactcgtcccgatccccaaatcccagggcttcccccaggtacacccaaagccgatccacctcttctgaaaaaaggtcctactcccgctctcccagctattcctccaagtctggcaagaggagcccgcccagcagaagctctaggtcccgccgcagccctagctactcccgctacagccccagcagggagcgggatcccaaatacagtgagaaggactcgcagcagcgggagcgcgagcgagcgcgtcggagacgtcggtcctactcgcctatgagaaagcgccggagagactccccgagccacctggaggcccggaggataaccagtgcccggaaacgccccatcccctactatcggcccagcccctcctcatccggcagcctcagcagcacctcctcctggtacagcagcagcagtagccgctcggccagccgcagctactcccggagccggagtcggagccggagccggagacggagccggacccgcacgagcagcagctctagctcccgcagccctagtccgggctcccgcagccggagccggagcaggagccggagccggagccggagcaggagccagagccggagctacagctcagcagacagctactccagcacgaggcgctaagtgcccctgagccagctgcccgtgggggccccttcgcgctgccagcctcccccaaccacctgccctccccgccttcttggtgacaaatagtgagggctcctataccttgtccttcctgcttgcctaggggaagaggagaagagggtaagggggcttcactctctagatcagcctgctaggagcctctaccagcatcatcctggggcccagctcaggcctgggcatatggaaagaaccatcatcttgtggcacaaaaaaagaagaaagaaaagaaaacttcaaggttttgtgagaagcaatgggtctgtgactcaaaaattgagccctggccaggaaaatgtggagacagttcttctcctccactgctcacaggaggcccgtggtaattctccccacctccccggatgccccactagtccaacttcatggctgcacgtggatggacccccatgtctgagaggggtgaaagaggagaccaatggcagttcaggttcaagataacggggtcaggcctttaacttcctcaaacaggcccaagcaaaggctggaagacatttgggtcctagaagaagggatatccttgaataccagatggggacgtttgacttggtgggaggtgtcaggagataggagttggttaagatgatagatagaaaaacggaagggttcagctgctgctcccaatacctcagcatggtaaggggacagagcccagcagatcccagctgtgaagaggccactgcatggctgacacaaaacacctcttggccattcacaggggccctgcaacctcacgagaaaggagatagtggaagagtcaggacaggttggtctccagccccacttcccaaatatgcctcagccccactagctggcaccaacttaattccacgggaccatctgctgaacattccccagtgccatggccagttgccaggccccagcgccagccagtctggccttaccctccggttggcgcctgccagccccctcccctctgcccaggctgccacgccctggatgccacccagtgcagcctggcacctacccacccacccttcagcttaagccactccccttgcctctcaggaattttgccaggatggggcacagcagctcaggtttgggggaaaagacccgaatccagagtgcaggggagaggggcttggatatgccatgtcttgggctcctgctggcttctgaggtttcttgtcagcttgggaaagacccacctttatttttgccctcaccccaagtcccccctggctggggctgggcagagagggtaagctgatctccgatccacaaataccaccagctgcttcatccacagaaggcgctaagaacggggaggtgaggaataagatccttaaaataaactcttgggcatccccctcaccagctgactggctttccggaggcttgtgggtgagtttcaagtttgtggtggcaacagcagcaggacagggcacggagggagcgagggagagaggaccggtcccagcttttggatattttgggttatggggaagcaagggccaaacattctttatccctcccaccccagggaaaacatttggaaaatagtcctttttcttggaagcagtgacgtctccctacccaatctttcccatcctatcaacccatggggctagagactgccatgcaaccaccaccacgacagcccttcctccatcagaagacaggagtgagggccccgggcagcagtggacgacccagcctccccataccgggcctctggcccagacctaagccctgcccacaaagactaatggatgccagtgctgtcactgcagaaggccagatggcaggtgcctgggacaggggcaggtgccccggggagggcaagtacagccactgtaaataaccctcgtccctgcccaggaacccagactggacttcagtctccctccatggagacaaaggcttcccagagccaccaaaaaccttcttagcaggacagctgtgagaggcatcagaacctcacgttcggactgccttcatcaagacaactctaggggaccattttgcctggggctcctagcaaacctttttatttattttatttatttatctatttatttatttgatgactgtctctctttctcgccattagcagtattgaattatttatttatacagaggttttgtgtgtgtgtgtgtgtgtgtgtgtgtgtgtgtgtgtgtgtgtgtgtgtgttggggggatctcctaaattatttctgtgcatctcctttttttttctgctgttttttatggatgggatttgagaggccaaaggtgagtgggctattggccttctccctgaaggctctaagcctggaacaccctggggttggcccagaaggaggcacatcagtcccaaaattcatcacttaacccagcgtccaggagggtcaggcctgtaccccagcctcctgtcccccaggaacctcacaggggtatcaaaaagatgtaaacagcccagaggcttatgagctacagtgatgaattgacacagtggagttgcaacttaggtgggggttggagtcgaaagttggcaaatggggccaaggctgcacaaagtcgaaatcccttgtgaatgtcccttagggaggcaccagattggagacagatgtgctatctcctaacagagtgatgaggcttcagttgagtacttgctgaagtagttgccttgtattttgagggccatggtggatgaaaatgatgtctggtttagtactggaattgcacttggggttgacaaggtgctcacaccatgagaatggaggcaggaattgagctgactgagggaagatgcaccttgatctcaccctcactccaaggcacatagcaggatcactccctagcttctctgagcacacctagttggtttcatgtatgttacacatgcttccactccacagtacctaatttctctctgtcccctgagatctgaaggctaccttgggaagaggcatcagccatcttgcttgagaaccaccaagccaaaagcaaaagcttttatctatgatctcttgctgtttcatcaggggaaagcacaaagctatttctgaaattaggaaaaaaaaaaaaaaggtggaaggagcagccagatgttccacaggaccccaccaagaaggtcatttccaaacccatcctggaagggcccaggatccaaaggtcatcagtcctgcttatctgaccaactggcagtgtcttctggctgctggccggagacagctcttgccctttccaaagtcactgtccactgccttgcaattgccagcttgtctggtccagctttgggtttggtgagacttttgcaacatccctggttgtttccctggcaatgtgactatccagccctaacccaaagcaagggagtgcccctttcctgggtgaagtttacaagaaggctgcttaaatgcctgcttcggggaaatctctgcctctctctctctctgtctctctctctgtctctctctctgtctctctctctctctctctctctctctctctctcagtgtatttctctactttcttttacatttcctttttttctatccaaaaacaatgtgcttgttgaggcactggtaaccctgattaaccagaacctcccattcccagtatcgctgttcctacgcccatttcaccctcattaccttctgcttccaaggaatatgacagatcaccaggatgctgctcgtcgtgaggatttatctcaaaaaccaacatccaaaatgggagggagatgtggcttgaggtcaagcgccatgcatcccaagcctttgaccttcccgctatggaagtgcactggatgacagaaactgaatacattgctccctttccctagggcaaagttcgacctctgttaagtggagggatttgtgagataaaaattcaaaatgttggcctgaggcctgagagtgtcaccaaagacagagggagcttcactgagactcagagggaaaaggaaaagagcctcaaacatttttaggaggttgtccatcatgaaagtaaaaacgaaaagcaagatttgatctcccttcagttaattaggcaaggctaagtaactcaaagccccctattagtaacattctggttcactgaggtttgatcatattcctatctgcattccttcccttctttgaaggacagctgatctttcagaagcagaataaaattaagatgttagaacaaaggtctcagtctcagagaaccgcatcacttcatttgctcagacccatcctcttttgcaaaagggtctgcttggagaggccaaaattcagggtgctctcaaaggcaaagaaagcacattgttttccttctccagtccaactttcatcttttcttctgctgttttcttttcccctcttctttttcacaaatgttcaaaatggtctcatgcgcatgtgtcttgccccactttcccctttagctgaacagaaaattttgtctcagtaaaacgaagtcaaaaaacaggattcctccaaacatgcctcctcccgcactggccagccgagtccagctgagaaacttatgctagattcaatgtcattgagcaatgctttattgaagtctcgttcttctcacttctgcaccagtgagccaatgatactgacagaaatgtcatctctcttctatctgtggttgctgtttttggagtaaaagtttctgtgtgtgtttttttagttcttttgatggctgttgttttgcattgtaaataccatgatgggggacccccatcagaacatggcttatttaataatttatttcgtatttattgagtaatattgggaaaagagaaggaccacctctttccctgaattgctattgagaattggtccatctcccagctccaggtgctgctgtctgcagcaagggcattactgcccaggtaaggagtgctagaatcaccaagcaaattgaaattggcagaaatggaggcttcagtcacacaaattagactcaaatggaactaaaacactggttatctccaggaaaacctcatttagatggaaattaatggaagaataaaatgcctacacatgaaccaacttctattaaaaagtcacaactccttgaaaaaaaaaataaagaaaaattgtaaactcttttttttttctggccaaggaaagctatgcctcatcttctaacgagccaagccaaaaagactgcaatggtattcctatgtgtttctttggcctgtgtatcagtctgaatgaaatggaatgggtctctagcctcagtcttgtcatctgtaaaatggggcttgtcctatatattatctgcaagacgtgggaaatgggggctcaagccctgatgctatggactccatactgttggatatattgtctcttgtgtcttctgctgactgcagattaaagggtgtcaaccaaggaaggaaacaaaaaagtagggcctggacttcatttgcagaatgaggtcatagtcgttgagtcccacagtcatatatgggagacctcaagttgctgtcaccttgataactcttgtatcctgggttaaagccctctgtatttagtttgaacttctctctaagccccgtggtccaaagtcatcacgggagagaccaagatgggcttaccttgccctgctctggatttaaccattgttcattgtcaggctatatttttgtacaatcattcaaataacccagtgacataggtcatattgccacttttcagaggagaaaactgaggctcaggagggggagttgacatgcccaagctcccttgagctcagatcagcttgactcaatgtccaacattcccttggtagctttttctccggggtcctgtgctataagaacttctctctgcactgtatttttttttctcccaattcttagctatttcctcaagcaatgattggccaaggacctagcataatccaccacattggccaaggggacgtggtgcaccccaaggccatttctctgcattggaggctgcgaatctcctctggaaaattcccaacccgaggacccaccatgagcccagctcagcctgaccagacagcctctgcctggagcattcacatcagatggaaagaagctgctgtgtcctccagcatcctgggaccctgtcctctgcccagtgacacagcagccatggctagcttgatttctggtctccaaagctaagcataaccttcccggggtttctggtttttcagcctgtacgaaacatgtctctgttctaattaaagttcccatggtatggtgttctca

SEQ ID NO: 180182 - DNA, 2381 bp, Homo sapiens
  Payload ID: 15495
  Gene Symbol: SRRM5
  Gene Name: serine/arginine repetitive matrix 5
  Uniprot ID: B3KS81
  ENST ID: ENST00000417606
  CDS Start-End: 16-2163
ccttttgcgcccaccatgtcttcacctaagagatcttcaaagcccagtatgtctctggcacccagtggatcctccatgcccactgcggatcccaagcctcctgcctccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactcccagtacagccaagtgtcaaaccccgactggaattccctccaaggagaagagtgacaacccatctccatcctcatcaaggaaggtgaagagctacggtcagatgatcatccccagtagggaaaagagttacagccccactgaaatgtccagcagggtcaagagttataaccaggccagcacccgcagcaggccgcaaagtcacagccaatctagaagccccagaaggtcaagaagtggcagtcagaagaggacgcacagcagagtgagaagtcacagttggaagagaaaccatagcagggcaagaagtcgcacccggaagggaattctgagccagatgggaagacacagccagtctagaagccacagcaaggggaaaagtcaaaaccaatctagaacccccagaagaggaagaagtcacaactggtctagaaaccccagcaaggaaagaagtcatagccattccagaagctccagcaaagagagagatcacaggggatctagcagccccaggaaggagagtggtcgcagtcaatcaggaagccccaacaagcagagagatcacagccgatctagaagtcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagacaatctagaagccccaacaaggagagagatcgcagccaatctagaagccccagcgaggagagagagcacagacaatccagaagccccagcaaagagagagatcgcagacgatggagaagccccagcaaggagagagagcgcagacaatctagaagctccagcgaggagagagatcacagccgatctagaagccccaataagcagagtggttacagtcgacctagagcctccagcaaggagaaagctcatagccgatctagaacccccagcaaagaaggaaatcatagccaatctagaacctctagcaaggagagcgaccccagtcaatctacagtccccagaagtcccgactggaagagatcccctactaggacaagcagtctcagtcagaatagaacccctagcaagacaagcagccactccccatcaacatttcccagtgggggccaaaccctaagccaggatgacagtcaagccgacgccaccacctctaaggccaccttacctggggaaaggtcttcatcatcttcttccaagctggcgtagcccccagtctcagctggctcacgggtctctgtcatgaccgggggaggggacaggagacaggagcagagcagcagctgagcagcgtccctccccggccagctctccacagccacacctccggccacaagttctctaatacaggatgttggcaggtagagagggatgctggatagggggaaaggaaagacctgtgatgattcaataaatttttacatagc

SEQ ID NO: 180183 - DNA, 2698 bp, Homo sapiens
  Payload ID: 15495
  Gene Symbol: SRRM5
  Gene Name: serine/arginine repetitive matrix 5
  Uniprot ID: B3KS81
  ENST ID: ENST00000607544
  CDS Start-End: 323-2470
aacctgtaggcagcgcttgagggtagcgggatagcagctgcaagcgcgcgtgggaggcgggggctctgggcggaacaaaaatcacaggatgtcagaggatgtttcccgggaagaactgggataaaggaagggtcccagcaccatggaggacccgaaccctgaagagaacatgaagcagcaggattcacccaaggagagaagtccccagagcccaggaggcaacatctttggcctgtgacaggcaatcaggtcatcgtccacggctaccaggtgtttcatgtctactgtgacttccaggaccacaagcccttttgcgcccaccatgtcttcacctaagagatcttcaaagcccagtatgtctctggcacccagtggatcctccatgcccactgcggatcccaagcctcctgcctccttgaagtccaccaaatcagcaacacccaacagatccttagtgcccaccaaaccagcgacatcccgtaactcagtcatgagcccaagcagttccaagtccaccaaatcgaccagtacaaaaagagccccttctaaccggcccagcagcaggtcccgagtccgcagcaaagcaagaacacccagcagggtgagcaccgacaccaggaccagcaaagccagcaaggccagcgacgtgagatgccaccagcggaggggcacacacagccggggtaggacacctggcagaaggggaagccgcagctccaagaggtcacccagcagggccagcactcctggcaggataagaactcatggtgccagaccaggcatggccagcagggtgagaactcccacttcacagcaaaaagggagccggggaaagagttacggccggcctagaaccagcaacagggaaaggagtgacagccagcctagaaatctgagcaagaagagttaccgcccaccaggaggctcaggtatagggaggagttccgagctggctgtaactcccagtacagccaagtgtcaaaccccgactggaattccctccaaggagaagagtgacaacccatctccatcctcatcaaggaaggtgaagagctacggtcagatgatcatccccagtagggaaaagagttacagccccactgaaatgtccagcagggtcaagagttataaccaggccagcacccgcagcaggccgcaaagtcacagccaatctagaagccccagaaggtcaagaagtggcagtcagaagaggacgcacagcagagtgagaagtcacagttggaagagaaaccatagcagggcaagaagtcgcacccggaagggaattctgagccagatgggaagacacagccagtctagaagccacagcaaggggaaaagtcaaaaccaatctagaacccccagaagaggaagaagtcacaactggtctagaaaccccagcaaggaaagaagtcatagccattccagaagctccagcaaagagagagatcacaggggatctagcagccccaggaaggagagtggtcgcagtcaatcaggaagccccaacaagcagagagatcacagccgatctagaagtcccaacaaggcgagagatcgcagccgatctagaagtccctacaaggcgagagatcgcagccgatctagaagtcccaacaaggcgagagattgcagccgatctagaagtccctacaaggcgagagatcgcagccgatctagaagtcccaacaaggcaagagatcatagccgatctagaagtcccaacaaggcgagagatcgcagccgatctagaagccccagcaaggaaagagatcacagccaacttggaagccccagcaaagagagagatcacagacgatctagaagccccagcaaggagagacagtgcagacaatctagaagctccagcaaagagagagatcacagacgatctagaagccccagcaaggagagacagcgcagacaatctagaagccccaacaaggagagagatcgcagccaatctagaagccccagcgaggagagagagcacagacaatccagaagccccagcaaagagagagatcgcagacgatggagaagccccagcaaggagagagagcgcagacaatctagaagctccagcgaggagagagatcacagccgatctagaagccccaataagcagagtggttacagtcgacctagagcctccagcaaggagaaagctcatagccgatctagaacccccagcaaagaaggaaatcatagccaatctagaacctctagcaaggagagcgaccccagtcaatctacagtccccagaagtcccgactggaagagatcccctactaggacaagcagtctcagtcagaatagaacccctagcaagacaagcagccactccccatcaacatttcccagtgggggccaaaccctaagccaggatgacagtcaagccgacgccaccacctctaaggccaccttacctggggaaaggtcttcatcatcttcttccaagctggcgtagcccccagtctcagctggctcacgggtctctgtcatgaccgggggaggggacaggagacaggagcagagcagcagctgagcagcgtccctccccggccagctctccacagccacacctccggccacaagttctctaatacaggatgttggcaggtagagagggatgctggatagggggaaaggaaagacctgtgatgattcaataaatttttacatagcacccatcccc

SEQ ID NO: 180184 - DNA, 1513 bp, Homo sapiens
  Payload ID: 15496
  Gene Symbol: SRSF1
  Gene Name: serine/arginine-rich splicing factor 1
  Uniprot ID: Q07955
  ENST ID: ENST00000258962
  CDS Start-End: 210-956
gttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaa

SEQ ID NO: 180185 - DNA, 3117 bp, Homo sapiens
  Payload ID: 15496
  Gene Symbol: SRSF1
  Gene Name: serine/arginine-rich splicing factor 1
  Uniprot ID: Q07955
  ENST ID: ENST00000582730
  CDS Start-End: 125-730
cgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgtttttaaatccaacaagatagagtataatatcaatactgctaaatctgcatgtcctctgtgtgactgatagagcgttgctatttcatttttttaagacaaaatgaaagcaaaatatagagttccaatgtattggtgtagataatctagttgggaatacttttaagtctcaccttcccctttaaactaatattcataattggttcatatgtttaaaagactttaatttacaaattaaattgcaaatgggagcattagatttagttttagacttaggtgggtagcaatgccagtaaacttaaattacgtaacttcttgcaaccacgaaacctgtaatacgctgtacagtaacaagtgttggcattatcagttgaactgtaaatacaaaatgcttcttccaattagtctctatgatgattaagtttctaaaatttatctgaacaccattcagaaacttgttttggggaatttgatagttattgatgtgcatctgttaaactgatgacagacataactcatcattccccagaaaccttttttgattacagtatctaacattttgcctcctcttttttggttttgctggttataaaggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattccaaagattttttttttcctatttttgacgattggagcccttaagatgcacgatggaattgtgttttgcgttttttggtaaaaggagcaaagcgaggacctggagataaacgctggagcaatctccttggaaggattcagcacgagtagatggtaaacatttaaaggggaaagggggggtttgtttaaaatagtaaatcagtaagtcacttctaaatttaaagaaaacaaaattggagttgaagaataagtaggtttccaattggctattgccgttttctttgaaaaaataaacattttttaaaaaactatgcatggttgtcctttttcctcttcatgtaagattctaactgggtctatcagttaatctttaaattgttaagtaagataagattttgactcttgtgttaatgtgttagcaaattaaaagttcttaaaaggcaa

SEQ ID NO: 180186 - DNA, 758 bp, Homo sapiens
  Payload ID: 15496
  Gene Symbol: SRSF1
  Gene Name: serine/arginine-rich splicing factor 1
  ENST ID: ENST00000584668
  CDS Start-End: 1-431
gagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattgacatatctgaagagatggattaagaatgctttggattaaggattgtggagcacatttcaatcattttaggattgtcaaaaggaggattgaggaggatcagatcaataatggaggcaatggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggctattc

SEQ ID NO: 180187 - DNA, 568 bp, Homo sapiens
  Payload ID: 15496
  Gene Symbol: SRSF1
  Gene Name: serine/arginine-rich splicing factor 1
  ENST ID: ENST00000585096
  CDS Start-End: 137-358
atatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacac

SEQ ID NO: 180188 - DNA, 1317 bp, Homo sapiens
  Payload ID: 15496
  Gene Symbol: SRSF1
  Gene Name: serine/arginine-rich splicing factor 1
  ENST ID: ENST00000584773
  CDS Start-End: 125-886
cgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaatgattatatacattttccttaaaacacttgcaaacattttattcagttgtctttagctacaattgctttgctttttaaaccttggcaattgtggcaaaattatattgcccattttgtagcaacttattttgctcccttccccccatttttgttttaatagggactaatgtgggaagaactggctaatttgtcacagtgcttagttacaactgttaatgtgtgacctgctgttggtgtacatgtgggtacagggtgttttta

SEQ ID NO: 180189 - DNA, 1720 bp, Homo sapiens
  Payload ID: 15496
  Gene Symbol: SRSF1
  Gene Name: serine/arginine-rich splicing factor 1
  Uniprot ID: Q07955
  ENST ID: ENST00000581979
  CDS Start-End: 96-701
gccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcgagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgaggtaggttatacacgtattcttttctttgaccagaattggatacagtggtcttaacagtggaatttcaaggtaaggattcaggcaaggttgtccaagtaaattgccagatttctggttttagttacattgtattcattcagcatgtctgaagatagatgaaagcttagatctttcaatggaaagttctgtctatccaatagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtttggattggagagggctcactggatcccaatccttggagctggatcattggattcaaatcataatgtggataggatagggaggatgaattaccaggattcatggagcgggatcagattaccaggaacataggagtggattcctgccccaaccaaaccgcattcgtgtggatttttttattcaacttaattggc

SEQ ID NO: 180190 - DNA, 1465 bp, Homo sapiens
  Payload ID: 15496
  Gene Symbol: SRSF1
  Gene Name: serine/arginine-rich splicing factor 1
  ENST ID: ENST00000583741
  CDS Start-End: 125-322
cgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgattgccgcatctacgtgggtaacttacctccagacatccgaaccaaggacattgaggacgtgttctacaaatacggcgctatccgcgacatcgacctcaagaatcgccgcgggggaccgcccttcgccttcgttgagttcgaggacccgcggtgaggcggcatggggcttgcagccttgaggaaatagagacgcggaagacgcggtgtatggtcgcgacggctatgattacgatgggtaccgtctgcgggtggagtttcctcgaagcggccgtggaacaggccgaggcggcggcgggggtggaggtggcggagctccccgaggtcgctatggccccccatccaggcggtctgaaaacagagtggttgtctctggactgcctccaagtggaagttggcaggatttaaaggatcacatgcgtgaagcaggtgatgtatgttatgctgatgtttaccgagatggcactggtgtcgtggagtttgtacggaaagaagatatgacctatgcagttcgaaaactggataacactaagtttagatctcatgagggagaaactgcctacatccgggttaaagttgatgggcccagaagtccaagttatggaagatctcgatctcgaagccgtagtcgtagcagaagccgtagcagaagcaacagcaggagtcgcagttactccccaaggagaagcagaggatcaccacgctattctccccgtcatagcagatctcgctctcgtacataagatgattggtgacactttttgtagaacccatgttgtatacagttttcctttattcagtacaatcttttcattttttaattcaaactgttttgttcagaatgggctaaagtgttgaattgcattcttgtaatatccccttgctcctaacatctacattcccttcgtgtctttgataaattgtattttaagtgatgtcatagacaggattgtttaaatttagttaactccatactcttcagactgtgatattgtgtaaatgtctatctgccctggtttgtgtgaactgggatgttgggggtgtttgtggttatcttacctggggaagttcttatgtttatcttgcttttcatgtgtctttctgtagacatatctgaagagatggattaagaatgctttggattaaggattgtggagcacatttcaatcattttaggattgtcaaaaggaggattgaggaggatcagatcaataatggaggcaatggtatgactccaagtgctattgtcacagatgaaattggcagtattgaccttatactaaaaggcaggggttaaaaa

SEQ ID NO: 180191 - DNA, 3487 bp, Homo sapiens
  Payload ID: 15497
  Gene Symbol: SRSF10
  Gene Name: serine/arginine-rich splicing factor 10
  Uniprot ID: O75494
  ENST ID: ENST00000344989
  CDS Start-End: 77-628
gtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaatgttttggattccttagtttcttattaggatatgatgtttctttacctatacattgatttcatcacatttgatttttgtcatcttttttgccacatacttaaaattttccatataaaattaactaaaaatctggaagtggaatttaagcttttaatttgtagcaattttgaaaatatagcagaggtatattttcaagggaggtgtgaaatggaggtattattgtttgtattttattttagaaattttgtttgaacttgcccaagatcacacagcaagtgtcagatcctaggttacagcccataatttttcacttgtttcatcttttgttaccatgtttgttgtttaatccaatggggaagtgtttttatagctttattttcatggagatagtaacattgatataatgggatctagaatttacttagagtcaaagtgactagatttaattacaaaaagtattttgttgtataccgttatacactcattaacataggggttcttatggacagaggttctatgtatttttaaaagaatatgtagaggctatagacttttttgccctctacctcccttctccatttccttttgaagttaagacatttaagggggagaattaaggtgcatattgagttggggttttgtttaaaaaaaattaggtaaatacatatataactacaataacaacagttggtagttctctaaaatatttaattatggtaaatcagaaaaggccctttaatttttgcatctgttgaatgaattgctttaggatctcttctgtggttgtttctctctatactgaatgctgtcaatattattgagcacttactgtgccgaaccatgtgcttttcaaatatttctatttaatcctaaaaacactcctgggaaatgggtattattcccattttacagatgagaaaattgtcctttgtagaatacccatcatgtgatagcttcttgcatattatgctattcatttctcacaaccttacaaggtaaatggataatgttcctggatgagagattaaacgtactcgaagatcttatggttgtgtggctcagagactctaagcatggctttccaaatctcattctcttgtagagattttccattgtattgcattttgaccatgttcctgtttacaaaacctaagattatattctgaagtatctgtgacttgagtgatagctcaggaataatctgagggcattctattaggaaggaggactagcaaagcctatagttagcctatcctaggcatgaactattctcattttagataggatgacttgataaataggatgaagtgagcaacctgtttgtcttcggttattgctatctacaagacattctgctagtcactgtggaaaagtttccttctcttgggttttttcctcttccccttcctcttaacagtgttggttatctttattatgtttctgtgtatttgtaacagctgtttcacccttgtattgcataatggggatttttcttggaataaaaagtgaggcatgtaaattcattgagaactaaccgtagtttgtaaagaagtaaaaggcctttgtatctagttttttgcagatcacatttctttgaatgctggaaagtgaaataaactggtctaggagccaaaaataaa

SEQ ID NO: 180192 - DNA, 2917 bp, Homo sapiens
  Payload ID: 15497
  Gene Symbol: SRSF10
  Gene Name: serine/arginine-rich splicing factor 10
  Uniprot ID: O75494
  ENST ID: ENST00000343255
  CDS Start-End: 73-858
gaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaaccggatgtctaggccaatgataattatttttgatgcagtgtggattagttcttttgttaaccccactgtcttggggaatgatgccagctgggaaattgagtttttgactgaaacatggagccttcactgctttttttctggttcctatgaagatttggaacatagaaaacacaaaaactcaccttaaaatttgagcaggtcgttgatggcaaaaataattttaaggaaaaaggaatattcttatgtagttattctaaagtttaaggagcgttgttgaccataatattgcttagttttcttactgctgttaagtaagtaaattgtttcaaagtaggttttgtgtgtgtgtgcctagtgtaaaagaactgaaattttgatgcttacagcacttggctcgtgcatttgtatcaaaatttgcctgcctctttatgagggaggcctgcttttcacacctcagtttatttaatacgaggcaagttgtaagacaacactcattctaggtgattctgtggtgccatgaaatttaaggtaatttggggaaaaggattagtcagttttaagcaagagtcacatcttttgagctttcgattatcagtgtagtacctgactaaaaatgaagtaatacccttaaaccatttataatttctagtatttctctgaaagatcgttttggggacaaaagtgacttgacatgtccaatttcatttcagaataaaaagctagcatctttaaaaatctcagattgcttgcttacagatacaagtacgaattatggacaaacgattccttttagaggattacttttttcaatttcggttttagtaatctaggctttgcctgtaaagaatacaacgatggattttaaatactgtttgtggaatgtgtttaaaggattgattctagaacctttgtatatttgatagtatttctaactttcatttctttactgtttgcagttaatgttcatgttctgctatgcaatcgtttatatgcacgtttctttaatttttttagattttcctggatgtatagtttaaacaacaaaaagtctatttaaaactgtagcagtagtttacagttctagcaaagaggaaagttgtggggttaaactttgtattttctttcttatagaggcttctaaaaaggtatttttatatgttctttttaacaaatattgtgtacaacctttaaaacatcaatgtttggatcaaaacaagacccagcttattttctgcttgctgtaaattaagcaaacatgctataataaaaacaaaatgaagg

SEQ ID NO: 180193 - DNA, 1194 bp, Homo sapiens
  Payload ID: 15497
  Gene Symbol: SRSF10
  Gene Name: serine/arginine-rich splicing factor 10
  Uniprot ID: O75494
  ENST ID: ENST00000374452
  CDS Start-End: 54-575
cgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattg

SEQ ID NO: 180194 - DNA, 866 bp, Homo sapiens
  Payload ID: 15497
  Gene Symbol: SRSF10
  Gene Name: serine/arginine-rich splicing factor 10
  ENST ID: ENST00000374453
  CDS Start-End: 40-558
tgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagccaagtaagcaagaagaaaaatgagagataatgcttcagtgagagaggaaaggtgctacatagagtatgagctgttaagttacatcccaggggaaagacctgggaactattgtattattctcttgaaaatttggcccagtaagctgctacatccagttcaactaacaaaatcctgtataccacagagaagaataaaggaaaccaaactgacaaacatccttcttttatttaagaccaaactgcagctggaatacccagtacagttctgcttactacacttcaagaaagatctgaaagcggaaaaagaaccaaagaagggcagttcaagcgaccaaaggg

SEQ ID NO: 180195 - DNA, 1808 bp, Homo sapiens
  Payload ID: 15497
  Gene Symbol: SRSF10
  Gene Name: serine/arginine-rich splicing factor 10
  Uniprot ID: O75494
  ENST ID: ENST00000453840
  CDS Start-End: 42-590
gctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgtacaccacatgcagtttacatctgtcttaactactccttcccaggtaaattccaattatatttgacatccagctaagagggcccatctcttctcacctctttcctagtcagtatattcagcaaatatttattgagcccttactgtgggcaaatcattgtactggataattgagaaaaatagataattcccttattcagtaaatgtctactgagcacaatctagtgaatcattacagtatggcctcattgttttgtttgaggtgtgttattcataacaatattttacaccattcgtatcaatgtaattatagaacacaatatacgatcaaggataagtaattgtgtggttatctgccatttaaaagtatccagtatttgatcacattattataaataatgaaaaaatgatttaatctgtaataaactggtttattgtgcagtgactgtaatatactagagttataataaattgtttactctgcctcaccaaacacatgctaggatataacccccaaaataagtatttaactttgcattaggtataaaggagactgggtgctataattagattattttgaggcagacagagagctgttatcctaactgatttagtatgttctgtaattgagaaaatgttcaccaaattatactttttagtgatttacatgtacattttataggggacatgttctgtgtatagcgaataaataacttttatagtatcacaaaa

SEQ ID NO: 180196 - DNA, 1089 bp, Homo sapiens
  Payload ID: 15497
  Gene Symbol: SRSF10
  Gene Name: serine/arginine-rich splicing factor 10
  Uniprot ID: O75494
  ENST ID: ENST00000484146
  CDS Start-End: 102-599
gtagcagagccctctagctgtgtgtgtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaaaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtgggaaaaggtatggtccaatataaaagttccatttttgccattattggcaaatcttgcctttgtttattttggtgccagtgttttctgcttaatcatttgctttgttggcatctgtgtttatttacttgta

SEQ ID NO: 180197 - DNA, 1631 bp, Homo sapiens
  Payload ID: 15497
  Gene Symbol: SRSF10
  Gene Name: serine/arginine-rich splicing factor 10
  Uniprot ID: O75494
  ENST ID: ENST00000492112
  CDS Start-End: 65-853
gccgcctgagccgcggacggtttgctgagcccgttagtgcgcccggccgagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaacagtagaccgactggaagaccacggcgtagcagaagccattccgacaatgatagattcaaacaccgaaatcgatctttttcaagatctaaatccaattcaagatcacggtccaagtcccagcccaagaaagaaatgaaggctaaatcacgttctaggtctgcatctcacaccaaaactagaggcacctctaaaacagattccaaaacacattataagtctggctcaagatatgaaaaggaatcaaggaaaaaagaaccacctagatccaaatctcagtcaagatcacagtctaggtctaggtcaaaatctagatcaaggtcttggactagtcctaagtccagtggccactgatagtataaaccatggtcatttttaggcatgtatcattcatttactcatagtttggtttacttaaattatcaggaatacaatgttgcaatgatgcttaaaaaacacttgttagttttccctgtaccaggcaatggttataattaaaatgatatgctgttgagaagccactcttaagagtccagtttgtttaatgttatgggcagctaccaatttgtggtgtctctgtatatttttgtaaagattctcattttttatgcttgaagtatttggtgaaaagatgttggttgaccataatttgcaacattgtctcattaaaaataaactttcatattcatatttggtagaactgttaacctagaaatgtagcttgctaataagatagaatgatacaaaagtgaagtagtagccacagtacaacactgactgctcagacacatttaggttcagggtggacctttatgtcttgtcaagatgtctaggcccggctgggcgtggtggctcacacctgtaatcccagcactttgggaggccgaggcgggcggatcacgaggtcaggagttcgagaccagcctgaccaacacggtgaaaccccgtctctactaaaaatacaaaaattatccgggcatggtggcacatgcctgtaatctcagctactcaggaggctgaggcaagagaatcgcttgaacctgggaggtagaagttgcagtgagccaaaatcacgccactgcactccagcctgggcaacagagtgagactccgtctcaaaaaaaaaaaaaaa

SEQ ID NO: 180198 - DNA, 1390 bp, Homo sapiens
  Payload ID: 15497
  Gene Symbol: SRSF10
  Gene Name: serine/arginine-rich splicing factor 10
  ENST ID: ENST00000495785
  CDS Start-End: 17-226
gagacacgccgccgccatgtcccgctacctgcgtccccccaacacgtctctgttcgtcaggaacgtggccgacgacaccaggtctgaagacttgcggcgtgaatttggtcgttatggtcctatagttgatgtgtatgttccacttgatttctacactcgccgtccaagaggatttgcttatgttcaatatcctttcttcagatggctgattagtgaggggtgttgaagtttgaaattcaagtttatagaatgtaaagctgtacagttatggcgaccccaaagagaaagcatgaaagaacctttagagtagagttcaacacttaaggcaagtagacaagccaaagacctcttaaggatcaggcttgaagagaagggagagtttgggaaaagaaaaaataaagaaaagctggaagaaggacaagcctaatgggagacaaagcctcgctttatctacaaaagggggaaaaggttgtttttcaaagttaaagataaagccatctgtcatatttggccaagcatctcatgacaagtccttctgacaagcacttaaagagttaaaggtcaagatgaagttgaatgatggccaagattaaaggagtcatacctgatcacatttgaggatgttcgtgatgctgaagacgctttacataatttggacagaaagtggatttgtggacggcagattgaaatacagtttgcccagggggatcgaaagacaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaagtaagtgtgctgtgtagcacagtgatctgtttaaaaaatgtatttgttagcatttaatttttttttactattttgtatacttttaattatatacattgaatgtttcattgagacaaaaaatactgtagcattttattttaaaagttttatggtttgcttttaattagaaactttgcctctatgaatagatatttgtcactgctttttctgatatgctttttagcagtagaccgactggaagaccacggcgtagcagaagccattccgacaatgataggtaaataactttgctttgaaaaagactcatgtattttttaatttcagagtgaacttttgctctaaaaataacaaatttgattaatatagaatctaatttttactctaattatatctctcctctgttttgaaagattcaaacaccgaaatcgatctttttcaagatctaaatccaattcaagatcacggtccaagtcccagcccaagaaagaaatgaaggctaaatcacgttcta

SEQ ID NO: 180199 - DNA, 778 bp, Homo sapiens
  Payload ID: 15497
  Gene Symbol: SRSF10
  Gene Name: serine/arginine-rich splicing factor 10
  ENST ID: ENST00000473858
  CDS Start-End: 77-199
gtctgaggctcggccgcctgagccgcggacggtttgctgagcccgttagtgcgcccggccgagacacgccgccgccatgtcccgctacctgcgtccccccaacacgtctctgttcgtcaggaacgtggccgacgacaccagcaccaaatcagatgaaagccaaggaagggaggaatgtgtacagttcttcacgctatgatgattatgacagatacagacgttctagaagccgaagttatgaaaggaggagatcaagaagtcggtcttttgattacaactatagaagatcgtatagtcctagaaatagaccgactggaagaccacggcgtagcagaagccattccgacaatgatagaccaaactgcagctggaatacccagtacagttctgcttactacacttcaagaaagatctgaaagcggaaaaagaaccaaagaagggcagttcaagcgaccaaagggtgggtggaaggtgctgcagtatgaatactgtacgaatattttgactctggtctgaaaagataaaagaatgttatcgaaaactacatggaataattgaagtcccttcaagtttgaaagtaagcattttaggacaaataaaaggaaattcaactttgtacttgtggaaactaatccctaaatatgaataggtttatattgattcatgggtaacaggtccataataaattattggaaactaggatgtctgaatatcaaggaagacagccatagtctcttacagtgcctctgttggtctgtctcaaactgaattgggtggg

SEQ ID NO: 180200 - DNA, 3034 bp, Homo sapiens
  Payload ID: 15498
  Gene Symbol: SRSF11
  Gene Name: serine/arginine-rich splicing factor 11
  ENST ID: ENST00000370949
  CDS Start-End: 564-1838
aaagcattttactgtacaggtaaggaatgtgccatgttgttttacctatctctctttctctctcactcccatgcacacatcctgtgtgtattcagagaccttcagaaacattcatattcattttcatgagtcagcaaaagccctacgcttgattccaacagaatatttcctttacatactttcttctcttaatttttacaaaatttgtatggtaggtgtaaaagaaaatcatagtaactgtaccatattattaacccctaaatcaaactttttttgtcttgtgtatcttgatttttctgtgtgctttatagtgaagcagccgacacgagtcgttgttcataaaacagcttttgaaagttgagagcacacccctggagaaccgactgtgcttgcttacgtttggttcatgacttaaaaatcgagtacaggtgatgaaatcttggcagtgttaacaaaaaagtagtgtgtattgtgctatttttttttactctagaaacttaaccatttgtagagaaaaaggaaacaaattttcacacattgaagttcattctgacataaaattaatgataaataatcatagaaatcaagctttgtattttagcgaacataagtactttcaacaaactcaggtggtgtatcagggagacattttctgggtgtttttgtgtgttttctgtcttagaaaagaatgtgttctaatgcaaggatgtttctctgcaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaactta

SEQ ID NO: 180201 - DNA, 3784 bp, Homo sapiens
  Payload ID: 15498
  Gene Symbol: SRSF11
  Gene Name: serine/arginine-rich splicing factor 11
  Uniprot ID: Q05519
  ENST ID: ENST00000370950
  CDS Start-End: 83-1537
agagaagccttttccgttgccggtgccggcctagcgtcctggaattacttcaatcaacaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaacaggttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaagaaaaaaaccttatctcttgcccttattttgaattttccactctttcattaatttgttttaagctccgtgttggaaaaaaggggtagtgcattttaaattgaccttcatacgcttttaaaataagacaaatctacttgataatgtacctttatttgatctcaagttgtataaaaccaataaatttgtgttactgcagtagtaatcttatgcacacggtgatttcatgttatatatgcaaagtaggcaactgttttcttagttacagaagtttcaagcttcacttttgtgcagtagaaacaaaagtaggctacagtctgtgccatgttgatgtacagtttctgaaattgttttacaagactttgataataaaacccttaaacttatgttcatgttcctgtaaaaccgtatttgtatttatttacgctactgaatgtatgacatttacctcattcattttacaaattctttccctttctgtccacatatttcagtatagtaaaaagaggaagtctatcactgtagtgataattgccatcaaaattgtcaaaaatgatttaatttctatccaaaatagtccttttcttagcttagtatcattttattgcttattttttgtgtgggaatggggttggataaagcaatgaactttagtataaacaaatcccacctatatctagcaaatttatattttcggtgaaatacagatatttgcctttctggagtagtatagaagctgtcaatatgtatctactgtacagtactaaatagtattcatttatgaaatgagtagtgtttgggtggctggggttaagggaaaatgagacttggaattgtagcttttatccaagttttgagtataaatagggttttgttttgttttttttaacctaaaaactgaaatgccatatagaaaaacagcattgtttttacagtttgtagtaagtaactttttaaagattttatcaaaaagaattgtctatagtgagtaaaagaagttctaataatggtcctaatcactgcatttttaaaaaacaaagttcaacacaaatgacatttgttttaaactttagtagataaaaggtgaaccatgtgacatgggcatttttgtaagtcaaaaacaaatttcacatatggtaaacctaatattcacagtgtgttccctcacttgtaatctctgaatacaaatatactagcttttctaaagggaatcatttttttaaaagtagtgccactgacaagatgctacagtgaagattatccattcttaggatatttattttcagtgaacattttctgcacaaaggtagtgttgcactgggacacaagccttttaacagataaccagttgaaatcaaacactgcctccacaccgagttctgttgtgtatttgatagtaaattgatttaaaaataaaagtggtttttgttagaaaaa

SEQ ID NO: 180202 - DNA, 2385 bp, Homo sapiens
  Payload ID: 15498
  Gene Symbol: SRSF11
  Gene Name: serine/arginine-rich splicing factor 11
  Uniprot ID: Q05519
  ENST ID: ENST00000370951
  CDS Start-End: 122-1573
gcagtccagatgtcgtcagcaccagcgcctgggctggaggacagagaagccttttccgttgccggtgccggcctagcgtcctggaattacttcaatcaagagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagagagagacgacgacgaagaagcaggagtggcacaagatctcctaaaaagcctcggtctcctaaaagaaaattgtcccgctcaccatcccctaggagacataaaaaggagaagaagaaagataaagacaaagaaagaagtagggatgaaagagaacgatcaacaagcaagaagaagaagagtaaagataaggaaaaggaccgggaaagaaaatcagagagtgataaagatgtaaaagttacacgggattatgatgaagaggaacaggggtatgacagtgagaaagagaaaaaagaagagaagaaaccaatagaaacaggttcccctaaaacaaaggaatgttctgtggaaaagggaactggtgattcactaagagaatccaaagtgaatggggatgatcatcatgaagaagacatggatatgagtgactgaatattgcctctgagggagtccaactgtatacctgcatcagtgtcattcctttgtgtgatttcttaatgctgtatttgttcatctcaaacctagatgtatacagctctgagttataaatggttataaagctcctgttactcatattagttatttacatcaaaaagcttttagaaaatggtacgaggtaaccaattcttgtcatggtgaaatctgattgagtaaccaagcagttttactattctggtgctgcttcataacaaaaatgaaaagctgcatgcatctacagcaggcatggattgtttatgtcgtatgatatcctttattaagtaagttcacttatagtatttctataatttgattcattgccgtaatagagccatgtaggaaatgcactgattgcatgttattgtggcaagaatatcctaaatgtcattaaaatcctccaacatgatggatctacttatggtcttgtttgttgacatgacaaattaacattcttatagttacatctggaaatgagcatttgaaatagataatcctttaagccttgtggcaaaatttttgtggcttttgtttaactttgaaaggttattatgcactaaccttttttggtggctaattagggtttaaatacagaaacaagatttcaaataaaactgtctttggcagtgagtaaatagcatattttgaagtagagttgtatactttttcataagatgtttgggaatttttttcctgaagtaataatttattccacatctacatcagtgaaagctatctacctatcctgagtctatcttaaaggaaaaaaa

SEQ ID NO: 180203 - DNA, 1408 bp, Homo sapiens
  Payload ID: 15498
  Gene Symbol: SRSF11
  Gene Name: serine/arginine-rich splicing factor 11
  ENST ID: ENST00000395136
  CDS Start-End: 242-1408
gcgaggtggggcggccgtttgttttctcgtggtctcgagctcgcgcgctctcatcccctcccccgcggcgtgcggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaagttgaatcatgtagctgctggtctcgtttcaccaagtctgaaatcggatacctctagtaaagaaatagaggaagctatgaaaagagtacgagaagcacagtccctaatttctgctgctatagaaccagataagaaagaagaaaaaagaaggcattcaagatcaagatcacgttctaggaggaggaggactccctcatcttctagacacaggcggtcaagaagcagatcgagacggcggtcacattctaagtctaggagtcggcgacgatccaaaagcccaaggcggagaagatctcattccagagaaagaggtagaaggtcaaggagcacatcaaaaacaagagacaaaaagaaagaagacaaagaaaagaaacgttctaaaacaccaccaaaaagttacagcacagccagacgttctagaagtgcaagcagtttgcacatttgtgattctagagagagacgacgacgaagaagcaggagtggcacaagatctcctaaaaagcctcggtctcctaaaagaaaattgtcccgctcaccatcccctaggagacataaaaaggagaagaagaaagataaa

SEQ ID NO: 180204 - DNA, 796 bp, Homo sapiens
  Payload ID: 15498
  Gene Symbol: SRSF11
  Gene Name: serine/arginine-rich splicing factor 11
  ENST ID: ENST00000473950
  CDS Start-End: 169-411
ggcggggcggagaaacggcggcggcggcggcggcatcggcagcagtagcagaggctgtagcatcggacaccctcctctctcccgcaatccggttcctcttccccctccttctcactgtttgttgtgtgtttgatgtgttaaagcaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggattccatgatccagactcagcagttgtggcacagcatctgacaaacactgtattcgttgacagagctttgatagtcgtaccatatgcagaagttcttttccctggttcagcctgaactatataccaggccctgctgaaaataccacccaacagttttcttctgcagcttatccagtttctcttaagtgccctgtacatatttgaagcagccgacacgagtcgttgttcataaaacagcttttgaaagttgagagcacacccctggagaaccgactgtgcttgcttacgtttggttcatgacttaaaaatcgagtacaggagttattcctgatgaagctaaagctttgtctctgttggcaccagctaatgcagtggcaggtcttctgcctggtggtggactcctgcctactcctaacccacttaccc

SEQ ID NO: 180205 - DNA, 760 bp, Homo sapiens
  Payload ID: 15498
  Gene Symbol: SRSF11
  Gene Name: serine/arginine-rich splicing factor 11
  ENST ID: ENST00000475204
  CDS Start-End: 54-440
cgggcccgctagtgtcgtggttggaggcgaggagcgagaacccgagcagcgccatgagcaacactaccgtcgtccccagcactgcaggtccgggccccagcggcgggcccggtggcggaggtggtggtggcggcggaggcggcggcaccgaggtaatccaggtgactaatgtctccccgagcgctagctctgagcagatgcggactctcttcggtttcctaggcaagatcgacgaactgcgcctcttcccgccggatgattcgcctttgccagtctcatctcgtgtctgctttgttaagttccatgatccagactcagcagttgtggcacagcatctgacaaacactgtattcgttgacagagctttgatagtcgtaccatatgcagaagtgaagcagccgacacgagtcgttgttcataaaacagcttttgaaagttgagagcacacccctggagaaccgactgtgcttgcttacgtttggttcatgacttaaaaatcgagtacaggagttattcctgatgaagctaaagctttgtctctgttggcaccagctaatgcagtggcaggtcttctgcctggtggtggactcctgcctactcctaacccacttacccagattggcgctgttccactggctgctttgggggctcctactcttgatcctgcccttgctgcacttgggcttcctggagcaaacttgaactctcagtctcttgctgcagatcagttgctgaagcttatgagtactgttgatcccaa

SEQ ID NO: 180206 - DNA, 3599 bp, Homo sapiens
  Payload ID: 15499
  Gene Symbol: SRSF12
  Gene Name: serine/arginine-rich splicing factor 12
  Uniprot ID: Q8WXF0
  ENST ID: ENST00000452027
  CDS Start-End: 195-980
ccgtgcgtccaggctggcgccgcgctgcgccccctctgcgccggcctctgcggctgcgcgctggcggggctgaggccgaggggtgggggtcgcgccgggggccggcggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccaggcctgaggacttgcgccgtgagtttggtcgatatggccctatagtagacgtttacattccacttgacttctacactcgccgcccaagaggatttgcttatgttcaatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaataggaggcggtcagacagccttaaagagtctcgacacaggcgattttcttatagccagtctaaatctcgttccaaatcattaccaaggcggtctacctcagcaaggcagtcaagaactccaagaaggaattttggctctagaggacggtcaaggtccaagtccttacaaaagaggtccaagtcaataggaaaatcacagtcaagttcacctcaaaagcagactagctcaggaacaaaatcaagatcacatggaagacattctgactcaatagcaagatccccgtgtaaatctcccaaagggtataccaattctgaaactaaagtacaaacagcaaagcattctcattttcggtcacattccagatctcgaagttatcgtcataaaaacagttggtgaacagcaacagaaagagcaccacgccgtctttaatataagttattaaactctcattatgttaaataaaaattctttaaggcatacagaaaatgcgagttgatattagttactttgggcatatggaagaaataaaatctctagctttggattaataaaaatttggtctccatttaaagggcccacactacaaattatgatttgtctaatgtcaccattttatggaccattttttatttacattgtggcagaagggtacttttcaagggaaatgagtaaactggaactaatttttaaaattctacttgcatagtattagtactattaataataccttttacacaaatatttttgactttaaagcactttcatgtaaaaagtaactatgactgtataattgcatagagcagacttaagctgtttgacacctatgtctcttttgtgtcttctgtttaaacttgggccaattcctggtggatattagttcatattacaaaattctgatgttccaaaaagtagaatatatatagagatcaaacattcaaaagatacattctctcctaagctcaaaggttatatttttattgggtagaacagtataggtaagttgacatgaaattgcatcctgcaccatgaccacattagtaatatcagaacttttgagaaatactggattttgaatggtttgagactaattctttaaaaattaggctgagcaacactcacaatccaaaaatattcatattaagacttacacatttgaagaatggtacattttgtataaaatcatatttgataccattatttccacatacctacttttcatctgttgcttaattttttctttttagagttcttgctcaactttatatggaacaagtcttattatttttgaaagagtgtttagtaccttgtattaagaaacttggccaagcgtggtggttcactcctgtaatcccagcactttgggaggtcgaggcgggcagattgcttgaggccaggagattgagaccagcctgggcaacatggtgaaatcctgtctctaaaatttaaaaaaaagaagaagaagaaactcgagactacatcttcaaaaaacaactttgcagtatttgaattttacattatactgcccttcatttctgacagccaaataactttattgatatttattgcttttgtagttgttataactaataatttctttgaaaatgtgttgtagtttatgtttttcaaagggttttggtagtgtttgtgatagaatggttttgcatatgattattataggggatatatttatagagctctacttgtatactttgtgacttacattatgaaaacttcaaagttctcaatccatacagttagtatttgtatccagagtgtttaagaaaaaaatctgtcttatatttttagtatataggagccagtgttgcttctatttgttttgaatacaaattccagttttctttgcatattagatcccatatgtaagaaacaaccttaaacaataatttgtatgctggtaatatttggacaagtgccataaattaatgtatattgtactttctgaatagattttctctaatcatagcaaaatttatttcaaaactacaactctttgaattattccgctataataaaatttagttataaaattatgtggcactactgaaaatctaaaggataatctgaagaatgagtaagacagatattgatagaaatttttagtattttcagaatgtttgggttcatacacataagtgaaatcattttaaaaactaggggctgggcacagtggctcacaccagtaatcctagcactttgggaggccaaggcaggaggattgcttgagcccaggagtttgagaccagcctgggcaacatagcaagacccctttatctataaaaataataataactaggtaccattgtgaaaaataataactagggattgattatagtatctttactctgtattcacaaatctctgtattcctgaacatatttaatcctttgatttacctctgactaggtttgtcattgtaatccctgggctgcttaggaggataccatttggtttgatgaaaaagctggaatgataatagctcaaactcttttgagcatttagtacatgcttggcactgttctatatgtcttaagttattcactcttgtatttaaccatcaacactcttatgaggtaaatatcccgcaattacttttgcgccaacctagtaccactacagacaaggaaacagatgcagagaggctaagttacaagggcacacagccataaactttggatctgtggagtgactgggcttcagagtcctcttcctgactgctgttcctatgtcttttgcaaagagaagtctttgacaggtatatgctttattaaaatcatgtttagaaagaaatgagagaatagaattagaaaaaggaatgactgtaggcttcgatgaaaatgacttttgtgactaggtgaaaattgtttggctgggtatcctggaaaattgtcttctgggaatatctatattccagggttcacttttgtcatagaattgtttcttggcccatttaagagagatactttgtttattaataaatcaaacgttttaatttta

SEQ ID NO: 180207 - DNA, 567 bp, Homo sapiens
  Payload ID: 15499
  Gene Symbol: SRSF12
  Gene Name: serine/arginine-rich splicing factor 12
  ENST ID: ENST00000517387
  CDS Start-End: 89-214
ggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccagatctaaagcagtccacagtagctggcaagcaccccccagtttgaaccaacctgttagctagaatccaagcataaacccagcaggcgagacaaaaggcacctaaagttcaagcatcaaggagtaaagagggagggtggacacagatataaagacctggaagaggggaagtctttatcaagcaaaagacaaagccaacaccaggttgagacttcggctttcctacatttactcagagttccagagtcaaagccaagtctgattttgttggttctgcgtctcttataaagtccatcttgcaagccttaaagagtaaaggtcaaggttcaagatcaagtgacattgagtgtccttaacagctagtcatatttgaagatgttcgagatgctgaagatgctctttataacctcaatagaa

SEQ ID NO: 180208 - DNA, 758 bp, Homo sapiens
  Payload ID: 15499
  Gene Symbol: SRSF12
  Gene Name: serine/arginine-rich splicing factor 12
  ENST ID: ENST00000475068
  CDS Start-End: 119-247
cgaggggtgggggtcgcgccgggggccggcggagctcctgtggtggtagcagcggtagcgggagacggagcgagtccagcggccgcgggcagacccggagggaacggaggaagcggtcatgtctcgctacacgaggccccccaacacctccctgttcatcaggaacgtcgcggacgccaccagaagatctaaagcagtccacagtagctggcaagcaccccccagtttgaaccaacctgttagctagaatccaagcataaacccagcaggcgagacaaaaggcacctaaagttcaagcatcaaggagtaaagagggagggtggacacagatataaagacctggaagaggggaagtctttatcaagcaaaagacaaagccaacaccaggttgagacttcggctttcctacatttactcagagttccagagtcaaagccaagtctgattttgttggttctgcgtctcttataaagtccatcttgcaagccttaaagagtaaaggtcaaggttcaagatcaagtgacattgagctagtcatatttgaagatgttcgagatgctgaagatgctctttataacctcaatagaaagtgggtatgtggccgtcagattgaaatacagtttgcacaaggtgatcgcaaaacaccaggccaaatgaaatcaaaagaacgtcatccttgttctccaagtgatcacaggagatcaagaagccccagccaaagaagaactcgaagtagaagttcttcatggggaagaaat

SEQ ID NO: 180209 - DNA, 572 bp, Homo sapiens
  Payload ID: 15500
  Gene Symbol: SRSF2
  Gene Name: serine/arginine-rich splicing factor 2
  ENST ID: ENST00000358156
  CDS Start-End: 172-572
agttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccgatcccggagtcggagtcgttccaggtctcgcagccg

SEQ ID NO: 180210 - DNA, 1927 bp, Homo sapiens
  Payload ID: 15500
  Gene Symbol: SRSF2
  Gene Name: serine/arginine-rich splicing factor 2
  Uniprot ID: Q01130
  ENST ID: ENST00000359995
  CDS Start-End: 215-880
gtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctc

SEQ ID NO: 180211 - DNA, 2885 bp, Homo sapiens
  Payload ID: 15500
  Gene Symbol: SRSF2
  Gene Name: serine/arginine-rich splicing factor 2
  Uniprot ID: Q01130
  ENST ID: ENST00000392485
  CDS Start-End: 174-839
ccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatggtaatgtctgggaatccgagacacataaccctaattcataaatgggatttggggtaggtctttttgagtcgtgttaatgtaagaatgactcctatcattaggagtgctgctcggaggttactcacctttgggagtaatactgaagagaggggtctgcagaaaggatgtgtatgaagcttagataataatggctgtttcgtaaactgtttgagacctattaatgaaaatgactatttcttgctgtttttatccaacgtctgcattttccccctttaaagctgcggtctcctgtttgataaaagaatattggccagtattgcagattttaactgatttggctgatcctccagggaccagtttctgtgggcgtgtattggagcaggtttgtctttaaatgttaaagatgcactatcctcttagagaaacaatcagttcaactattgttgtactgactgggacttcatattctaatggatgtggcaaaagaattgcaataagaagcagtgaacatttggaaccccaaaagaaagttacaggtattgcactgggtggggaaaggatagtgtgtctttaactcttaaattgtttggtcctattttttaaaaaggaaagggccctaagtagctcagatattaaagtagtattctcaattaccaaatgtttcatttgaaacaatttatcttaatgaaatatagaccaattctctgatctcgagttgtttttgtttggatacagcccttttttttttctttttttttcttccccttacctttcttcaccttggttatttggccaggaatacgtaaattcaaacttgtacatgctgatggtagcctttgtgaaattttcctaattgggccttttaaaaacatggctgggtggaacatttctgtaccctactggtttgaccagagccttagtaagtacgtgcctgaaactgaaaccatgtgcactttaatggaaggtaagctgaacttctttcttttcaaacctagatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgtatttttgtgcactaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttttctcagaa

SEQ ID NO: 180212 - DNA, 1357 bp, Homo sapiens
  Payload ID: 15500
  Gene Symbol: SRSF2
  Gene Name: serine/arginine-rich splicing factor 2
  Uniprot ID: Q01130
  ENST ID: ENST00000452355
  CDS Start-End: 172-837
agttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgctgcggtctcctgtttgataaaagaatattggccagtattgcagattttaactgatttggctgatcctccagggaccagtttctgtgggcgtgtattggagcagatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaa

SEQ ID NO: 180213 - DNA, 1390 bp, Homo sapiens
  Payload ID: 15500
  Gene Symbol: SRSF2
  Gene Name: serine/arginine-rich splicing factor 2
  Uniprot ID: Q01130
  ENST ID: ENST00000508921
  CDS Start-End: 172-801
agttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggttattttgtaacatttgtctaactttttacttgtttaagctttgcctcagttggcaaacttcattttatgtgccattttgttgctgttattcaaatttcttgtaatttagtgaggtgaacgacttcagatttcattattggatttggatatttgaggtaaaatttcattttgttatatagtgctgactttttttgtttgaaattaaacagattggtaacctaatttgtggcctcctgacttttaaggaaaacgtgtgcagccattacacacagcctaaagctgtcaagagattgactcagcattgccttcattccttaaaattaaaaacctacaaaagttggtgtaaatttgtatatgttatttaccttcagatctaaatggtaatctgaacccaaatttgtataaagacttttcaggtgaaaagacttgattttttgaaaggattgtttatcaaacacaattctaatctcttctcttatgta

SEQ ID NO: 180214 - DNA, 1359 bp, Homo sapiens
  Payload ID: 15500
  Gene Symbol: SRSF2
  Gene Name: serine/arginine-rich splicing factor 2
  Uniprot ID: Q01130
  ENST ID: ENST00000585202
  CDS Start-End: 149-814
ctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcaggtacgggggcggtggctacggacgccggagccgcagccctaggcggcgtcgccgcagccgatcccggagtcggagtcgttccaggtctcgcagccgatctcgctacagccgctcgaagtctcggtcccgcactcgttctcgatctcggtcgacctccaagtccagatccgcacgaaggtccaagtccaagtcctcgtcggtctccagatctcgttcgcggtccaggtcccggtctcggtccaggagtcctcccccagtgtccaagagggaatccaaatccaggtcgcgatcgaagagtccccccaagtctcctgaagaggaaggagcggtgtcctcttaagaaaatgatgtatcggcaagcagtgtaaacggaggacttggggaaaaaggaccacatagtccatcgaagaagagtccttggaacaagcaactggctattgaaaaggcgcagttgtgtagcagttgagtaatgctggttagctgttaaggtggcgtgttgcagtgcagagtgcttggctgtttcctgttttctcccgattgctcctgtgtaaagatgccttgtcgtgcagaaacaaatggctgtccagtttattaaaatgcctgacaactgcacttccagtcacccgggccttgcatataaataacggagcatacagtgagcacatctagctgatgataaatacacctttttttccctcttccccctaaaaatggtaaatctgatcatatctacatgtatgaacttaacatggaaaatgttaaggaagcaaatggttgtaactttgtaagtacttataacatggtgtatctttttgcttatgaatattctgtattataaccattgtttctgtagtttaattaaaacattttcttggtgttagcttt

SEQ ID NO: 180215 - DNA, 561 bp, Homo sapiens
  Payload ID: 15500
  Gene Symbol: SRSF2
  Gene Name: serine/arginine-rich splicing factor 2
  ENST ID: ENST00000583836
  CDS Start-End: 172-561
agttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatgagctacggccgcccccctcccgatgtggagggtatgacctccctcaaggtggacaacctgacctaccgcacctcgcccgacacgctgaggcgcgtcttcgagaagtacgggcgcgtcggcgacgtgtacatcccgcgggaccgctacaccaaggagtcccgcggcttcgccttcgttcgctttcacgacaagcgcgacgctgaggacgctatggatgccatggacggggccgtgctggacggccgcgagctgcgggtgcaaatggcgcgctacggccgccccccggactcacaccacagccgccggggaccgccaccccgcagccgatcccggagtcggagtcgttccaggtctcgcagccgatctcgctacagccgctcgaagtct

SEQ ID NO: 180216 - DNA, 4222 bp, Homo sapiens
  Payload ID: 15501
  Gene Symbol: SRSF3
  Gene Name: serine/arginine-rich splicing factor 3
  Uniprot ID: P84103
  ENST ID: ENST00000373715
  CDS Start-End: 117-611
tttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaataccaagaattgttactttacaatgttcccttaagcaaaattgaatttgctttgaacttttagttatgcacagactgataataaacctctaaacctgcccagcggaagtgtgtttttttttaaatttaaatacagaaacaactggcaaaaattgaactaagatttacttttttttccatagctgggatataggctgcagctatagttgaacaagcagtctttaaaaactgctgtgaaacacaggccatcagggaaaacgaaatgctgcactattaaattagaggtttttgaaaaatccaactctcatcctgggcagaggttgcctagttggtatagaatgttaagtttcaagaaagtttacctttgctttaggtcataagttccttatttgattgctgtatatggatacatggctgttcgtgacattctttatgtgcaaatttgtgatttcaaaaatgtcctgccagtttaagggtacattgtagagccgaactttgagttactgtgcaagatttttttttcatgctgtcatttgtaatatgttttgtgagaatccttgggattaaagttttggttacaaattgttctttaacttgaaagcctgtttttccttgcaaactcaaatctgtgagcttggtaccaagtccaggtataacattcctattggaagccatacttatattttcttgtaaagtgcttttgaattaataaaatattagcataattgtgtatagtcagttgaacccactgttaccattgttcttatcccatgggaagcagttggttacacgattcttattttataagaaacagctgagaggcactatggattagtcttctgaagtgaaggaaatatagatgtcacctaagtgatagttaacccattttttttttttttaggcatagaagccagttcagggtccataatatttagtgaccaacattttaaagtatagcagcaacctggttcttaaacacaaagtaagttgcccattaacaaatggcttttatctttagcatgaaaactttccacaggtctaaaaattgcttccattttataatttgaggtgttgcatgggaattctaagctgatccatcatgatgtaaaagttcacaatatggttcaaatgtaacagtgcagaattgaatatggaggcatgcataaccttcctcttagaaaatggcaggtgttgtaatttcaaatttttgtgcaattagattaaatcataatgcaacagtcttgtggcttagtttccttaaatatgctcttaagatagttttggattatgcggtattgactgtcttaaatatgaaagataagtcattgcattaagagttcaagctaaatggatacattaagatacagttcctaaacaaattatttatttccaccttttacacaaatcttgggagaattggtgtcaggaaggttcagccttaaagttaagcatgttcaagaaagacacttttcagacagcctgtttatttactgagagctctggcattgggcattttgtctttagtattctcacatagcctacaacctgttcctgttaggaacaagccaagatagctaagaagttacggaagccatgcaatatgtcaattacattgctttttataaatggacaacttatgtgggcatttttgggcagtatatgacttccttgcaggctcttaagttggaagggtttctgtaaaaaggacagttacgggtataatatggctaagagaaataatacagaacctgaaataaaagtaacttcaccagggagttatcctgacttaggtgacatacagtcccagttggcagttactttaaccaggagccctagcataacctcaagactcttagaaactttagaacatggaaattgttaaaagctttgaattgcacatttagattgtggctattaggaatttttaaagttgtaattcctaaaataacaggtcacactaaccggtcttgtccatattcagggttgagtgtaaaaatgaaaggaatcacaaaactgaacttagacctgtggtttaaggatcaaggtgttcactagaagtcactgttactaatacttgatgacaatgtaaagaaacattaaggattatatttgattgttttcaaagacactggctggatgtggtggctcacacttgtaattcctagcactttgggaggctagggcgggtgggaggatctcttgaagccaggagttggagaccagtctgcccaacatggcaagattcacatttctattaaaaggaatatttagtttgatctctggttcacagttcattgtgggttgcttctgacctccatgtcttaagcagaaagtagggaagttgtagttttaccaagcacaggtaccctgtgtctaccatttgagtatcttagagatccttacaaacgtgatcccgtcagcgtccatgacactcccaccctgttagactgctgtcagtggctttcacacaaacccatatgtggatggaaaatccaggttattactacattcattttagtacagtgctgcctaattagaaattttgttgaagaggtatttcagaatagatacagccagactccaggctcattgacttagtttttcagggtgacctaaccctgtgtaattttgaggagttctacatgataaatacccttggtgatgtgagaaccactagtttagtattttgtccaagtatgctttttttcagagttctgaatgagatttagttgtcatacctagttggtggtaatttcttagttgtatatttttgtactaccagattgttgccttctggttttccatcttttcgagaaagatttctagttaaagttactgaagaaaaactgggttggaagtacatttttctctaaataatccagtagtgttgaatttgattttatgtccactctaatttttttcatcctgttttattagggggattcatcgggtacctgaagataattcagctgtagaccccttaaggttctgagacaaggtcattgaaatttgttttggctgggtgtgatggctcatgcctgtaatcccggtgcattgggaggttgaggcaggtggatcacttgtggtcaggagttggagaccagcttggtcaacatggtgaaaccccgtctctactaacagtacaaaaattagctgggtgtggtggcaggcgcctataatgccagccacttgggaggctgaggcaggagaagtgcttaaacctggtgggtggaggttgccatgagccgagatgtagccacttcactccagcctgagtgaaagcaaaacttcgtctccaaaaaaaaaaaaaaagtttgttttggtaagcctagtataattgattagttttgtccatgcaactttccccttgttggactctgtacttaataatacagtatttagattctca

SEQ ID NO: 180217 - DNA, 1095 bp, Homo sapiens
  Payload ID: 15501
  Gene Symbol: SRSF3
  Gene Name: serine/arginine-rich splicing factor 3
  Uniprot ID: P84103
  ENST ID: ENST00000477442
  CDS Start-End: 94-468
gagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcaccaccctctgaatctgcattagccagtcaactagccctttcagcgtcatgtgaccagcgcgccccattcagcttggctggtgtcgtttcacatgacccaggctggccagtcgtcaggttgcaccgccctttggttcccgagcatgctgttttctctcagccttctctccaaccttaaccaaatcggcagcagccacctcgaccgcccacacattcctggccaatcagctcagctgtttatttaccaaatgtcttcacaacaactacagcagcagccttcggctaacaaaaaagcaggaaaaatccacaacacccccttcgccaaccaactaaatccaacgcaacatctggcaaaaccttttcagcaaattcttcctggccgtcagtccggcagcctcacctcaccatttctagcttgttgaaacccaaaactaatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacagg

SEQ ID NO: 180218 - DNA, 869 bp, Homo sapiens
  Payload ID: 15501
  Gene Symbol: SRSF3
  Gene Name: serine/arginine-rich splicing factor 3
  Uniprot ID: P84103
  ENST ID: ENST00000620941
  CDS Start-End: 167-661
gtgacgttcagcacggggcggtggcgggggctcccggcccatcggagggtttcctagtcttggagtggaagtctttatattcctcattggggcatgagccaggatgggggttacctgggagttgggaaccacaaaggggagccgatagccgagttgtattccagaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagatctccaagaaggagaagcttctctcgcagccggagcaggtccctttctagagataggagaagagagagatcgctgtctcgggagagaaatcacaagccgtcccgatccttctctaggtctcgtagtcgatctaggtcaaatgaaaggaaatagaagacagtttgcaagagaagtggtgtacaggaaattacttcatttgacaggagtatgtacagaaaattcaagttttgtttgagacttcataagcttggtgcatttttaagatgttttagctgttcaaatctgtttgtctcttgaaacagtgacacaaaggtgtaattctctatggtttgaaatggatcatacgaggcatgtaatacca

SEQ ID NO: 180219 - DNA, 595 bp, Homo sapiens
  Payload ID: 15501
  Gene Symbol: SRSF3
  Gene Name: serine/arginine-rich splicing factor 3
  ENST ID: ENST00000613941
  CDS Start-End: 132-419
ggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgggcttttggctactatggaccactccgaagtgtgtgggttgctagaaacccacccggctttgcttttgttgaatttgaagatccccgagatgcagctgatgcagtccgagagctagatggaaggctggagtgcaatggtgtgatcttggctcgttgtaacctctgcctactgggttcaagtgattctcctgcctcagccgcctgagtagctgggattacagaacactatgtggctgccgtgtaagagtggaactgtcgaatggtgaaaaaagaagtagaaatcgtggcccacctccctcttggggtcgtcgccctcgagatgattatcgtaggaggagtcctccacctcgtcgcagagtcaccatcatgtctcttctcacc

SEQ ID NO: 180220 - DNA, 2387 bp, Homo sapiens
  Payload ID: 15502
  Gene Symbol: SRSF4
  Gene Name: serine/arginine-rich splicing factor 4
  Uniprot ID: Q08170
  ENST ID: ENST00000373795
  CDS Start-End: 236-1720
gccgagcgggaagcgaacgcgcgctctctccggttaccttccgcctcggggaagggcgggggaagtggaagcgcgcgctcgcgagctgcgtgctcgcgtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtctcgctctcgaagcagacattcccgtaagagcagaagccgaagtggcagcagcaaaagcagtcattctaagagtagatctcggtccaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcccgctccgtgtcaaaggagcgggaacatgccaagtctgaatccagccagagggaaggtcgaggagagagtgagaatgctggcaccaatcaggagacccggtccaggtcgagatccaattccaaatcgaaaccaaaccttccatcagaatcacgctccagatcaaagtcagcttcaaaaacccgatctcggtccaagtctagatccaggtctgcttccagatcgccctcccgatctagatctaggtcccactcaaggtcctaactggctatggccacagctggaactacccgagaagtcttttgtacatgtttggtagccgtagcacaagtgattggagtagaacatgtcactgctgtacatttttaactcccctaatggtgtgtctataattgttaaatctaagtgcttcctctcagtaaagcctcctggcaccaggccttcctgctcgactgaaaaaaattttctctttgaaaatccccttttactcatggcccacagtagaatatccaaaacgccttggctttcaggcctggcctttcctacagggagctcagtaacctggacggctctaaggctggaatgaccacataggtaggtatggtgagttcaaccatttttgctcttgaattgatgcccttcgatgtatgccatttagtgaaagtgctaagtcttaagtttcctaccactttggtttcatatttttggacttaacaaagttgtgaatagcacagtcgaggaaaattgatacctgcagtaacccataggaaataaactgtagagttccatattctggtattgtgattatattgttttatattaaaaaagaaaagaaaagaattttttttaattttatttttccccgtcttgcaaagtatagtgacccctgtttccattaaatttgaataaagactatttttgcttgacaaaa

SEQ ID NO: 180221 - DNA, 1399 bp, Homo sapiens
  Payload ID: 15502
  Gene Symbol: SRSF4
  Gene Name: serine/arginine-rich splicing factor 4
  ENST ID: ENST00000605204
  CDS Start-End: 139-621
gtacgtcgccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggtctgttatgttctgaacccacacatgttttcggaaggaccagatggctgacactggctaatgggaaccaaaagacgagtgaaagtaacctggttgtcacatacccccagcttagaggtgcttcaccctgccccaaggtggggaaagatcaagtgcagactgagctgtggccaacgtttgcagaccaggaatccacactagctctaatcagagagcccttggtgtgcgggaactgccagtttgccgacgtgaaaagagtcccagactgggtaatggtgagccctgaagtcgcaccccagctctgccactcagtgagcacggcaacatccctaatcctgaccagccatggagaggttcggttcttacaaggaaaatgagtgaatgtgggaatggctcaccacattgtgaaaacaaaactcacatcctgctgatggttggctgaggactgtcatgtccacatacaaagaaaagcatgtggcacagttttaggacaaagatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcaatttaacaaagacctcaatgttttaattaaaagaatcctttgaggctaagatgactgcctgttccatttgctgaccttgggttacctttccatgcgtggctctttgaaccattgtggcccttggctgaccaaaaacaggaagccatgtgacgaccgcaacctttccccattagacctgggtggtgaggatcccaagggttagacacagatgagattaaactgaaataggtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttcca

SEQ ID NO: 180222 - DNA, 1264 bp, Homo sapiens
  Payload ID: 15502
  Gene Symbol: SRSF4
  Gene Name: serine/arginine-rich splicing factor 4
  ENST ID: ENST00000466448
  CDS Start-End: 131-1264
ccggggttcggctgcgtccgtcccgccgcccgcccgttgccgccgccgccgctgccgccgtgctctcgctttgcccgccgccgcctaaggggggctggggccggggccagccatcactgccgttgccgggatgccgcgggtgtacatcggccgcctgagctaccaggcccgggagcgcgatgtggagcgcttctttaagggctacgggaagatcctggaggtggatctgaagaacggatatggttttgtggagtttgatgatctgcgtgatgcagatgatgctgtttatgaactgaatggcaaagacctttgtggtgagcgagtaattgttgagcatgcccgcggcccacggcgagatggcagttacggttctggacgcagtggatatggttatagaagaagtggccgagataaatatggccctcctactcgcacagagtacagacttattgtggagaatttgtcaagtcggtgcagctggcaagacctaaaggattatatgcgtcaggcaggagaagtgacttatgcagatgctcacaagggacgcaaaaatgaaggggtgattgaatttgtatcttattctgatatgaaaagagctttggaaaagttggatggaactgaagtcaatgggagaaaaatcagattagttgaagacaagccaggttccagacgacgccggtcctactccagaagccggagtcattcaaggtcgggctcccgctcccggagcaagagccggagccggagccagagtcggagccggagcaagaaagagaaaagcaggagccccagcaaggaaaagagccgcagccgcagccatagcgctggcaagagccgcagcaagagcaaagaccaagctgaagagaagatccaaaacaatgacaatgtcgggaaacccaagagccggagtcctagcaggcataaaagtaagagcaaaagtcggagcaggagtcaggagaggagagtggaggaggagaagcgagggagtgtgagcaggggcaggagccaggagaagagcctccgccagagtcggagccggagcaggagcaaagggggcagcaggagccggagcaggagccgcagcaagagcaaggacaagaggaagggcaggaagagaagcagagaggagagccgcagtcgcagtcgcagccgcagcaagagtgagaggagcagaaagcgaggcagcaagcgagacagcaaggcgggcagcagcaagaagaagaagaaggaagacactgaccgctcccagtccagatctccatcc

SEQ ID NO: 180223 - DNA, 393 bp, Homo sapiens
  Payload ID: 15502
  Gene Symbol: SRSF4
  Gene Name: serine/arginine-rich splicing factor 4
  ENST ID: ENST00000489898
  CDS Start-End: 1-136
ttatgaactgaatggcaaagacctttgtggtgagcgagtaattgttgagcatgcccgcggcccacggcgagatggcagttacggttctggacgcaaatcctttgaggctaagatgactgcctgttccatttgctgaccttgggttacctttccatgcgtggctctttgaaccattgtggcccttggctgaccaaaaacaggaagccatgtgacgaccgcaacctttccccattagacctgggtggtgaggatcccaagggttagacacagatgagattaaactgaaataggtggatatggttatagaagaagtggccgagataaatatggccctcctactcgcacagagtacagacttattgtggagaatttgtcaagtcggtgcagctggca

SEQ ID NO: 180224 - DNA, 1638 bp, Homo sapiens
  Payload ID: 15503
  Gene Symbol: SRSF5
  Gene Name: serine/arginine-rich splicing factor 5
  Uniprot ID: Q13243
  ENST ID: ENST00000394366
  CDS Start-End: 308-1126
gacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagcgcagttgattcgaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctg

SEQ ID NO: 180225 - DNA, 567 bp, Homo sapiens
  Payload ID: 15503
  Gene Symbol: SRSF5
  Gene Name: serine/arginine-rich splicing factor 5
  ENST ID: ENST00000554021
  CDS Start-End: 68-484
agtagcggaccgtgttgggagggagctgggttttcattttgtctgcaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcagcctgtctgtgtcgttggccttatgacgaggagtgcctgtgggttatcctaatcgttgtcttggtcactcttggttgggcctggttgactttgccagtcagctcctacagtgatcagttggccacctctagatct

SEQ ID NO: 180226 - DNA, 1500 bp, Homo sapiens
  Payload ID: 15503
  Gene Symbol: SRSF5
  Gene Name: serine/arginine-rich splicing factor 5
  Uniprot ID: Q13243
  ENST ID: ENST00000557154
  CDS Start-End: 152-970
gccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaa

SEQ ID NO: 180227 - DNA, 1412 bp, Homo sapiens
  Payload ID: 15503
  Gene Symbol: SRSF5
  Gene Name: serine/arginine-rich splicing factor 5
  Uniprot ID: Q13243
  ENST ID: ENST00000553635
  CDS Start-End: 115-924
gcgtagacgagttaagtcctggtctgcgtggaggtcgacgactccgtcgcagactacggacctgtctgggtctcagccgccaaagaccccgtccggaagtactagccggacatcatgagtggctgtcgggtattcatcgggagactaaatccagcggccagggagaaggacgtggaaagattcttcaagggatatggacggataagagatattgatctgaaaagaggctttggttttgtggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgc

SEQ ID NO: 180228 - DNA, 565 bp, Homo sapiens
  Payload ID: 15503
  Gene Symbol: SRSF5
  Gene Name: serine/arginine-rich splicing factor 5
  ENST ID: ENST00000555349
  CDS Start-End: 68-442
agtagcggaccgtgttgggagggagctgggttttcattttgtctgcaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggtttgttgaaatacagttttgagttattttgatgtggctttttaaaaaagttaatgggtagctaatgttgtattgttttattaaaagtagttttaaattaatggatttaatggaattgtaattttaaacatt

SEQ ID NO: 180229 - DNA, 2815 bp, Homo sapiens
  Payload ID: 15503
  Gene Symbol: SRSF5
  Gene Name: serine/arginine-rich splicing factor 5
  Uniprot ID: Q13243
  ENST ID: ENST00000553521
  CDS Start-End: 1454-2272
gccggaggaagcgccacgggcggctcagacctgaggccgcaagggcgcgccgggcgggcagggcggagggtccgatttcctccctctgaacggaaaaaaagccactttccctgggaagaactcgaagaagttggatgtctgatcttcaccttggatttgtggtctcggcccgcgggcgactcaccccacccaccaggatcccacgaagccgggccggctcagcccgctggcgccatctagtgtcgaatgaggaggcggccctctgcggctggaggggacgcttgggcgtgtgaaatctgaacggagaggattaaccaaataccatttggacttaaaagcagcttgaggccgggcgcggtggctcatgcctgtaatcccagcactttgggaggccgagacgggccgatcacgaggtcaggagatcgagaccatcccggctaacacggtgaaaccccgtctctactaaaaatacaaaaaaattagccggtgtggtggcgggcgcctgtagtcgcagctactcgggaggctgaggcagaagaatggcgtgaacccgggaggcggagcccagatcgcgccactgcactccagcctgggcgacagagcaagactgtctcaaaaaaaacaacaaaaaacagcttgaaacctcttccagccactctcccagagtgacggacatgcagaaatctgtattccagcctcaattcaagacagccttctagctgcagtcccattttcaacatttcatcagtgaaaatcctttcatttaaaaaatacttcagtgccttagtcttctcaccacaacaaaaccacacagctgtggcatggttgaaaaaagaactcgaacatctaggagctccctgctttgagggcaaatttaaattgcaagcagcaagagctaaggaaaggccaggtatttctgcaaagctaagtttctcctaattagtaatcttctgggtgtctaagaaaaactttagatacaagaagggttgccacttttctcaggagactcttctgggagagatgatgatgaaccgaacgccaaggacttagcaggggcgaacgacgtcaacagatgtccctccagactccggcaccagccggccgagcccaaacgagttctcgcccccgaccccacccaccgcgggagcagggttcggtcactcgcagtgtcagagaggcccacatcctcctaaatttccggccctcccaaaacttccgtcttccctaggtccaacggggtggacccaaggcccaggggcgtccccggaagtgacgtaggacgcgccctccattttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaaatgtcttttgataagccttctgctcacatttttgtgaatgtctgaagtatatagtttgtgtatattgacagagctcttttataactaaagcaaatttaatttttttgtactagaaaaaaatttgaacattttagttcttggttataaaaatgttaattcagaattagtttaatgccttaattaaactaattaatagctttggacacttaaaagagctctaaatttgcttgtacataaaggcttaatttgttttccttgttagggtcaagggtgtcctccactctttaacagctgctggacagacacattagagcagctgtttgttattgataataaaatattataaaact

SEQ ID NO: 180230 - DNA, 526 bp, Homo sapiens
  Payload ID: 15503
  Gene Symbol: SRSF5
  Gene Name: serine/arginine-rich splicing factor 5
  ENST ID: ENST00000553548
  CDS Start-End: 164-463
attttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgttgaacacaagtgctgtcattgcatttcttccattgtgaatacgaattttcttcctcagaaatgctc

SEQ ID NO: 180231 - DNA, 613 bp, Homo sapiens
  Payload ID: 15503
  Gene Symbol: SRSF5
  Gene Name: serine/arginine-rich splicing factor 5
  ENST ID: ENST00000553369
  CDS Start-End: 164-578
attttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcagcctgtctgtgtcgttggccttatgacgaggagtgcctgtgggttatcctaatcgttgtcttggtcactcttggttgggcctggt

SEQ ID NO: 180232 - DNA, 2057 bp, Homo sapiens
  Payload ID: 15503
  Gene Symbol: SRSF5
  Gene Name: serine/arginine-rich splicing factor 5
  ENST ID: ENST00000555547
  CDS Start-End: 90-506
ggaggtcgacgactccgtcgcagactacggacctgtctgggtctcagccgccaaagaccccgtccggtaggaagtactagccggacatcatgagtggctgtcgggtattcatcgggagactaaatccagcggccagggagaaggacgtggaaagattcttcaagggatatggacggataagagatattgatctgaaaagaggctttggttttgtggaatttgaggatccaagggatgcagatgatgctgtgtatgagcttgatggaaaagaactctgtagtgaaagggttactattgaacatgctagggctcggtcacgaggtggaagaggtagaggacgatactctgaccgttttagtagtcgcagacctcgaaatgatagacgaaatgctccacctgtaagaacagaaaatcgtcttatagttgagaatttatcctcaagagtcagctggcagcctgtctgtgtcgttggccttatgacgaggagtgcctgtgggttatcctaatcgttgtcttggtcactcttggttgggcctggttgactttgccagtcagctcctacagtgatcagttggccacctctagatctgtgtttgccggtctagacgttatcggtgcacttccttgaagtgccaggttgcagcgatcccagagcgttgataacgtgatctgatccctaagttgagacctgtcttcctgtaacgcttccgaataagaggtccggtcgaaaagagttgaaagatacgaaattaggtggtcgttggaatcctgatcgcagtaaagtggtccttggtaactgctcgagtagaacatgtctgcatccgccaatagtccgctaatagggagggctgtgcgattaaaggcttccatcgattgggtagtgtccttcaagtgggtggcgaagagccagtcgggcatatgtcatgaaggtttctccgaccgattaatggtttgctgcttgactagcctagggaaataataataaaggtaaagtaaacttttttaatgacatatggggcacaaaataactggtgtcttgtaaatgttctgtttttttaaataaaacttctctactttagtctttactttaaaaatatgtactgtttccttttttgttgtttttttgtttgtttttttttcttttgtactgagctcagcatagactaatactaccttaatgttaaaatctgaatttcttttagcattttgcttaaaagcaatatgctatttgcttattccgtgccctgacatagataatttttgaattctgatagaatacaagtgtggtaaatgccatgtttgtactttatctaacatcttctctttcagtagtcttgttttttttatatcatgtgattgtttgtgtgtcccctttcctcttctttgcttaacacaattatcttgtgttaaggatctcaaagatttcatgagacaagctggggaagtaacgtttgcggatgcacaccgacctaaattaaatgaaggggtggttgagtttgcctcttatggtgacttaaagaatgctattgaaaaactttctggaaaggaaataaatgggagaaaaataaaattaattgaaggcagcaaaaggcacagtaggtcaagaagcaggtctcgatcccggaccagaagttcctctaggtctcgtagccgatcccgttcccgtagtcgcaaatcttacagccggtcaagaagcaggagcaggagccggagccggagcaagtcccgttctgttagtaggtctcccgtgcctgagaagagccagaaacgtggttcttcaagtagatctaagtctccagcatctgtggatcgccagaggtcccggtcccgatcaaggtccagatcagttgacagtggcaattaaactgtaaataacttgccctgggggcctttttttaaaaaacaaaaaccacaaaaattcccaaaccatacttgctaaaaattctggtaagtatgtgcttttctgtgggggtgggatttggaaggggggttgggttgggctggatatctttgtagatgtggaccaccaaggggttgttgaaaactaattgtattaa

SEQ ID NO: 180233 - DNA, 4325 bp, Homo sapiens
  Payload ID: 15504
  Gene Symbol: SRSF6
  Gene Name: serine/arginine-rich splicing factor 6
  Uniprot ID: Q13247
  ENST ID: ENST00000244020
  CDS Start-End: 107-1141
gtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcagtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtgttgtttttttttttttttttttttttttttttttttttttagtatttcagcaggatctgctggcagggtttttttgttttatttgtttgcttatttttaaattaactgttttgagctttgaatacttaaggctttagagggagaacccaattttcaattatgttggctttttataaagcttgagttatgtaagatttaaataaaagtttgctaccaagatgattgccttattgaataggtcactattaaattcctttaaatgttgatatctgccatttgtggaaacaacgtaaattctacttaagtgtaaacaaggcaagcctcagaccagcaataaattactcagtttggataacattattttgtgcagttaatcaaatttgccaaagtctttatctgcccctttaacaagttgagtaaaaataaaaggtattttttagtcaatgtgttccatgattttgcttaaattaatacttttaagtaatggaacttttttcaaaggcaaatttaaactatttaagaaatagctcctaatacttgggatcttgtttagagaatccactttctggaagttctcagcataattagtgttgagagtggttcagttgtctttaatgtttgtcatgtggaaatggaagtagcctctttttgttctgaaattgagtttattcaaagtgtaaaagcacatactgcattttctgctgaaagatcattatgtttaacaggcacttaatctcagtaaagtcagttgccagttaagttccacccagtagtcagtcccctttgtagttagtgggattatttgataattggttagatcatacttgtaaattttaatgctttgtgtaattggtttgaaaaacagtgaaatgggtaaacgcaaaacttttgtactttattacgagtaaagtgtaatgagtactgtggaaaccaaatttgaatactgcaaatttgtaggagttactaggttagcaattagtccatacatccataagcctgatgagttgaaattgcagtttgagaagtgaattaaccttacatccctttgttcagataccttaaaagttactttatttaaaagcatttattaatcttagtctgaaatcaaaatatagattaattggctcagctttaatacctttctaggaggtgtcacaatgtagggtaccaagggttggattgtgatggggcatggtcgtacactgctcattgtgccacaggtgtgactggaaagcatgatattctagggttggtttgtagattcaaataatccagaaatatacctaataagattgagtgaaaaatttgagtcaaatatctagggcattcacagagtagctgtgagttcttggtaatgtgaaaaaggccttgtttttcagaaattcctgggtttcctgttaaaaaatcttaaagcccaaccttaggaatatagtgccccaaaaggcggatgcttcttccattatcttattttctttgatactttatttaattagatgtttataaagaaatgggtttatttttccagcataaacctcagaatttaaggaaagaaaatgatgtctgttgttatagttcattgttttgcctactcagcagaagtgatgactcttaaaaattggctttgaccaaagttctcttgttttcagggaaagaacataaaagctttttgaactacagcctttttaaaagagggatgggaggatattacagtaagaaattaggctttctaaaagtatgaaacatccttcaactgggctctcttgttaataggacatcatatggtaatagactggtttgactatattgttagctgccacagtaagcaggtcattgtataggtaaatgcctgcacccataattttctagtaatagccacgaccaatttattaacagtcagggcctatccttgcctgtagttctcagtcactggatgcacaaaatcactgtgtaacattggctcacttggtgagcatagggttgactgataaaatgtttaattcccttgctagcttgtgagaagaatgagttgatgacatgctccataccagtggctagatggagtattaaggtggagcagaaaagaagtgagaacatcttgattcccctttcttttacttgatggtgtttatgaacatgccgtagtgcctttatggccagtttgagtcctgcctactttgacttttacgttcccattcctgtgttaccaccttcctcccgatttgttcacctattttgtgctttaaatctcaataaaatacttactgagggaaaggcttgttttgagtttattgcatatgcccacttaggaccagattcttaacaaatgtttttttgaattggagtttgcattggcaagccattcctgtcttgagtatgagaacaggatcttgtgttcacttacccagaaacgtgagtttgggatttagtatatggtttatgttgggcaactcattaatcactgtgcttcagtgtcatccatgaaactagggataaaacatgcatgggatgtgaagattaaaagtcaagaatatgaacagtacaagagagtaccataacaaatacaattttatttacaaatatacatggttggaccataccttggaatctacttgctaatgcagctgctgttaacagttcttgtatctgctcaagagatttctatgatcatataaaaatgcctttttaggttttcagtgttcatgccctgagtagtagtctgcagtttgctttaatacatggtaatacagagatcggctttaaatggctggctggttactgttgaatgaatgtatgataaattttttttcagaaccaacagtgtgaataatcctttcagttgtctatcagcatgaatttaaaaattactttcaagattcaacattacacaataaaacttagagttcttgcaataga

SEQ ID NO: 180234 - DNA, 1680 bp, Homo sapiens
  Payload ID: 15504
  Gene Symbol: SRSF6
  Gene Name: serine/arginine-rich splicing factor 6
  Uniprot ID: Q13247
  ENST ID: ENST00000483871
  CDS Start-End: 107-514
gtgaggcgcgtgttcgggctcttgccgtccccgcacccgcaccgcggttactggcttgcggtccgccgttcgacaaccagcccttgggtccccgcccgccacggacatgccgcgcgtctacataggacgcctgagctacaacgtccgggagaaggacatccagcgctttttcagtggctatggccgcctcctcgaagtagacctcaaaaatgggtacggcttcgtggagttcgaggactcccgcgacgccgacgacgccgtttacgagctgaacggcaaggagctctgcggcgagcgcgtgatcgtagagcacgcccggggcccgcgtcgcgatcgcgacggctacagctacggaagccgcatgaccaatggggctgaggctgtgtccactgaggctaagatgactgcctttcctgattggccttggcttttccatacattgtgtgacccttgccctatgaccctttggctgaccttaccggaagccatgacgacagcagccttttgccattagacgcagggtgatggtgaggattccaagggttagacaaaactggttaatctgaactaggtgactgttaccttgcgtgttttgtggccaaaccaccaccaaaaacctcacactgtgatgtggtggaggtggatacagcagtcggagaacatctggcagagacaaatacggaccacctgttcgtacagaatacaggcttattgtagaaaatctttctagtcggtgcagttggcaagatttaaaggattttatgcgacaagcaggtgaagtaacctatgcggatgcccacaaggaacgaacaaatgagggtgtaattgagtttcgctcctactctgacatgaagcgtgctttggacaaactggatggcacagaaataaatggcagaaatattaggcttattgaagataagccacgcacaagccataggcgatcttactctggaagcagatccaggtctcgatctagaagacggtcacgaagtaggagtcgcaggagcagccgcagtagatctcgaagtatctcaaaaagtcgctcccgttccaggtcgcggagcaaaggtcgatcacgttctcgatcaaaaggcaggaaatctagatcaaagagcaaatctaagcccaagtctgatcggggctcccattcacattctcgaagcagatctaaggatgagtatgagaaatctcgaagcaggtctcggtcccgatcccctaaagaaaatggaaagggtgatataaagtcaaaatccagatcaaggagccagtcccgttccaattcgccgctacctgttccaccctcaaaggcccgttctgtgtcccctccaccaaaaagagctacttcaagatcccgttctagatctcgctcaaagtcaagatcaaggtccaggtcgagttccagagattaactcagaactccttgtttgcacattattatggaacactttcctacttaggcagttactcttccatgtttatacttggcctcttctgcaagaggaatctcttgaaaacaggggcacacagaaatttgatttgtggccaaattggatgaaaaagatgaggctctaaggaaatggtggcatgaagaccctctcccttctttgtagaattaagataactttgattttatagcttttgagctaacgtaacttttgtaaagattaagctcatttagtg

SEQ ID NO: 180235 - DNA, 2489 bp, Homo sapiens
  Payload ID: 15505
  Gene Symbol: SRSF7
  Gene Name: serine/arginine-rich splicing factor 7
  Uniprot ID: Q16629
  ENST ID: ENST00000313117
  CDS Start-End: 239-955
agtctcttcagttccttccgcgtcgtttcttggctgtttccgcccagctcctttgtgccgcgcagaacaacgagatgacgcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataa

SEQ ID NO: 180236 - DNA, 1050 bp, Homo sapiens
  Payload ID: 15505
  Gene Symbol: SRSF7
  Gene Name: serine/arginine-rich splicing factor 7
  ENST ID: ENST00000409276
  CDS Start-End: 103-810
gtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 180237 - DNA, 747 bp, Homo sapiens
  Payload ID: 15505
  Gene Symbol: SRSF7
  Gene Name: serine/arginine-rich splicing factor 7
  ENST ID: ENST00000452806
  CDS Start-End: 1-331
tgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaa

SEQ ID NO: 180238 - DNA, 1847 bp, Homo sapiens
  Payload ID: 15505
  Gene Symbol: SRSF7
  Gene Name: serine/arginine-rich splicing factor 7
  Uniprot ID: Q16629
  ENST ID: ENST00000431066
  CDS Start-End: 27-425
agagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaacta

SEQ ID NO: 180239 - DNA, 2857 bp, Homo sapiens
  Payload ID: 15505
  Gene Symbol: SRSF7
  Gene Name: serine/arginine-rich splicing factor 7
  ENST ID: ENST00000425778
  CDS Start-End: 160-573
gcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaat

SEQ ID NO: 180240 - DNA, 603 bp, Homo sapiens
  Payload ID: 15505
  Gene Symbol: SRSF7
  Gene Name: serine/arginine-rich splicing factor 7
  ENST ID: ENST00000432873
  CDS Start-End: 1-213
cgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccacctcctgagtagctgggactgccattgtgtaccacagtgcccagctgagggatctgtgccttaagtgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactaga

SEQ ID NO: 180241 - DNA, 2453 bp, Homo sapiens
  Payload ID: 15505
  Gene Symbol: SRSF7
  Gene Name: serine/arginine-rich splicing factor 7
  Uniprot ID: Q16629
  ENST ID: ENST00000446327
  CDS Start-End: 239-919
agtctcttcagttccttccgcgtcgtttcttggctgtttccgcccagctcctttgtgccgcgcagaacaacgagatgacgcatgcgcaaagcgcagcggccgcatatataaacgcgaacccgggctcttcctcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggtggcatagtgttaattaggactccccaagatatggggagttctactctcaatggtcttgtttctttgctttctacattagttaaccagttttataccaaaaaatgcatgtttgaggaattgtctgaaattgggacaaaacaccttcatgtaaaccagctttgcaaaattttccagcccagatactcttcatctattcaaatggattgtcttattctgagcaaagacctgttgttaatcttcaagctaggttttgcagttcccaaccacaacattcttctattttgccaggctggtgcaaagtaattaaagatgtcaatcagaaatgtcaatgagactaaagtggttttgtaaatctcagctatatttagcaacactccatgtagctaatattttttggtagcatctggtagaccttagaatgttacatagccagtaggttctttattcaaattttaagtatcttaagaatagtagggcagtaacagttacttttgagagttttctggtcaagcttttaccaggcattctctagccttggtacaaaaaaaaaaaaacctgctggttgcgcagatacctaggcttgtccattttatgcatttcagcaaagtcattggatactattgcaacttgggaatactggtctgcatcaagtttattcggtagtttgaccgctagtatgttggaagttatttggattgtttttggaattttgactggctgaattatggttggtataaagttatgtgtataactggcaggcttatttatctgttgcacttggttagctttaattgttctgtattatttaaagataagtttactcaacaataaatctgcagagattgaacaaataa

SEQ ID NO: 180242 - DNA, 1903 bp, Homo sapiens
  Payload ID: 15505
  Gene Symbol: SRSF7
  Gene Name: serine/arginine-rich splicing factor 7
  Uniprot ID: Q16629
  ENST ID: ENST00000443213
  CDS Start-End: 97-495
ccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtatttattttaataaaggaatggttggtattctagttaatcaagtaattcttttattagcaaggcagaaactagtgtttttctataaacttgaatgttaattgtacaggtgtattttacaatttttgtttaattaaaaaaatgttactatattaataatcaacctggtcaaaacctttcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtttattttaaatacacattacagtgttttatattatgtaatgctaagttgtaattcagcttttaacaaatctttttttaggtagtaaaaaaaaaaatactcaacaactaataggcccagagtttatttccaaatgagacactaaatttaaatagttttgagatttgatttcagcagaggcacacaaactcttaaaaacgagttattgtctgacattttgttttttctctaacttgaaaaataggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttccaatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcaca

SEQ ID NO: 180243 - DNA, 1135 bp, Homo sapiens
  Payload ID: 15505
  Gene Symbol: SRSF7
  Gene Name: serine/arginine-rich splicing factor 7
  ENST ID: ENST00000415527
  CDS Start-End: 540-695
attccgcgtgcgtaatggcggcttaggagcacgccagacgaagccggaggcagcggaggcggggtgctgaagggagacgggatggcgggtgtacatctctgccgagttccgtactcttgggcatttttgtggcccaatccagcctaaagcagggttgagatgacggttttcgcgttgcctttctcggagctgcccgccggcccccctccccccccgccctcggcggcggctgccattttgcgcacattgaggaccgtggtggcgcatttcctcagcgctttcccgccacttcagcggacagatctggccgcagctaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgaggtatttcca

SEQ ID NO: 180244 - DNA, 1944 bp, Homo sapiens
  Payload ID: 15505
  Gene Symbol: SRSF7
  Gene Name: serine/arginine-rich splicing factor 7
  ENST ID: ENST00000425941
  CDS Start-End: 108-521
tcgtagtgccgccgggactcttggcgggtgaaggtgtgtgtcagcttttgcgtcactcgagccctgggcgctgcttgctaaagagccgagcacgcgggtctgtcatcatgtcgcgttacgggcggtacggaggagaaaccaaggtgtatgttggtaacctgggaactggcgctggcaaaggagagttagaaagggctttcagttattatggtcctttaagaactgtatggattgcgagaaatcctccaggatttgcctttgtggaattcgaagatcctagagatgcagaagatgcagtacgaggactggatggaaaggtgatttgtggctcccgagtgagggttgaactatcgacaggcatgcctcggagatcacgttttgatagaccacctgcccgacgtccctttgatccaaatgatagatgctatgagtgtggcgaaaagggacattatgcttatgattgtcatcgttacagccggcgaagaagaagcaggtttcttcgtttgagtcagtcgccttgattcagaatgtcacgagccttatgatatcatgctgaggcgccttgcaaatccgacaattaagatcctcctagaccttgaggtgatcagcataagaggccagatcccctcgagtcatctacacctagcttcaccttattctttaaagggcagaaaatttgagacggtgatcgccgtaacagtaaatttggcttacaattggggcccccctccggtttagaaagaggaacaccagattgaccacattcccaactagaaaaatcttcttgcgtcaatcaagcctcacctggctcatttggctgtcagtttgatcgtcgttagattgaagaaaacatctagatgcagcgatcggctatagatacttctagatcgtctagatctactagaccatgggccaaagagggtcgacctgcaaacttgcaaggtcacggtctagatcacattctcgatccagaggaaggcgatactctcgctcacgcagcaggagcaggggacgaaggtcaaggtcagcatctcctcgacgatcaagatctatctctcttcgtagatcaagatcagcttcactcagaagatctaggtctggttctataaaaggatcgagatccccgtcgaggtcaagatcaagatccaggtctatttcacgaccaagaagcagccgatcaaagtccagatctccatctccaaaaagaagtcgttccccatcaggaagtcctcgcagaagtgcaagtcctgaaagaatggactgaagctctcaagttcaccctttagggaaaagttattttgtttacattattataagggatttgtgatgtctgtaaagtgtaacctaggaaagataattcaaccatctaatcaaaatggatctggattactatgtaaattcacagcagtaagataatataaattttgttgaatgtattaacatcatatggtctgaaaatgtgggtttttatttggcacatttaaataaaatgtttctaactagatttttgatttgtgttcaatattaacacttcttaatttgatatatttgagagtcagacattataattgttaaccttattcatacatacctacattcagaattgaaaggtgttggttaagtcttgaacatcactattctatgcataaaacttggccaggatcttaagggactttgaaaattccatcttacccttgtagctctgggtaagatgacctgagtcccttatgatacagcctgaatgcatcatgacagatccttaagttagctaatccgtttgaagttggtgttagtaggtattgtatgatcagtggtgaagcaagtaggaccactgatgtgtctaaatgagcatgacaggaactaaacgaaactgattaaatgtatgagaaatagaaacatttctggatgatctttatactaattgcagctttcaggctactaggt

SEQ ID NO: 180245 - DNA, 4028 bp, Homo sapiens
  Payload ID: 15506
  Gene Symbol: SRSF8
  Gene Name: serine/arginine-rich splicing factor 8
  Uniprot ID: Q9BRL6
  ENST ID: ENST00000587424
  CDS Start-End: 31-879
agtttccgggcccgggctgctctcggagccatgagctgcggccgcccccctcccgacgtggacggcatgatcaccctcaaggtggacaacctgacctaccgcacctctcccgacagcttgaggcgcgtgttcgagaagtacgggcgcgtgggcgacgtgtacatcccgcgggagccccacaccaaggcgccccggggcttcgctttcgtccgctttcacgaccggcgcgacgcccaagacgccgaggccgccatggacggggcggagctggacggacgcgagctgcgggtgcaggtggcgcgctatggccgccgggacctgccccgcagccgccagggagagccacgcggcaggtccagaggcggcggctacggacggcggagccgcagctacgggcggcggagccgcagccccaggcggcgacaccgcagccgatcccggggtcccagctgctccaggtcccgcagccgatctcgctataggggttctcgctatagccggtctccctacagccgatctccttacagccggtcgcgctacagccgctctccctacagcagatctcgctacagggaatctcgctacggcggatctcactacagctcatctggttacagtaactctcgctacagccgatatcacagcagccggtctcactcgaagtctgggtcctccactagctctcgctctgcatcaacctccaaatcgagctctgcgcgacgatccaagtcctcctcggtctccaggtctcgctcgcggtccaggtcttcatctatgaccaggagtcctccccgggtatccaagaggaaatccaagtcaaggtcgcgatccaagaggccccccaagtctcctgaagaggaaggacagatgtcctcttaagaaaatgatgcatcaggaagcaacgtgatggaggacttgggggaaaaggatcacatactcagtctatggaagcaacgtccctggaagaagaggctgcctattgaaaaggttgtgtcacacttttctacctttttgccagtttgaagctttgcatcaggtggcaaaattcattctatgtgccgttttgttgttattcacattttattgtaacttaggaggtgaacgacctaagattacgttattgggtttggatatttgaggcaaaaatttatttttatttctatagtgatgactgttttggtttgaaatgaacagattggtaacctaatttgtggcctcctgacttttaaggaaacgtgtgcagccattacacacagcctaacgctgtcaagacatgcttcaacattgccttcattccttaaaaacctacaaaaggtggtgtaaattaatatggataattttatttacctccaggtctaaaaggtagtgtgacccaaatttgtataaagatttttcatgtgaaaggactggggttttagcaaacacaggtctaatctcttttgtgtttttgtgcaccaggcccggctgcgtagcagttgagtgatgctggttagctattaaggtggcctgttgcagtgcagagtgctgagctgcttcctgttttcttctgattgctcctggggaaaacacgccttgtcctgaagaacaaatggctgtccagtttattaaaatgcctgtcaactgcacttccagtcacccaggccttgcagataaataatggagcatgcagtgagcacatctagctgacgataatcacaccttttcccccgtcttttctgaaaaattgtaaatctgatcatatcaacatgtatgaacttaaaatatggagaatgttatggaagaaatagtttataagtttgttaagtacttataacatggtttatctttttgattattaattttttacgctaaccattgtttctgtagttaaaattgttttcttggtgttatcttttctcagaataaaattagaaacttttgatggaaagtaggttgttttattttctgtatgacttttggatatttgtacttttgagaaaattattagcaccaagtgtttctcaaaatataatttttaaaaaatccttaataggcttttagctatgtgctttattgttttatcacaatgcagtttatttgtagtttctctcttttttcctcacacctatggtttttttacttccaaaattattttcaaataatccatttttggctttcatcattatccctactagatgttatgtgttcttttgcaattgtttctgcttatacctttactagcaaagggaaaaataacaatttggtgtcaatgatctggtgacaataggattacattggagccaattgaataaatttattctttcaatcatatggatcttcattaatatttttgactgaattatcaattaaaaatatttcattccctttgtgcagaaactgctaaatccagggttcgattcttgaatgaactggcaaggtggctgtggtctgtagatatacatcccacattttgttgttataacagttagtagttagtattgctttcatatatagactccagaatctaaattttacgataatgacatttcttctggtcatgacaaatgtaatattttacaaatataaatctacgtagaatccaaagacacacacagagcagtcctgtctgagaaataaaaaatcaggacacccatggcatcgtagtagcccctcgcgtccagcaggtggcgaagggaggtgaggtatatttattaaatgggaccgagtgggacggggacggggcagccctaagggtagggaagcattgtcaatttctggggatagaatgagacccaggcatagctggagtttgaagctttgaagcaaaaatatctgtagaacatcttaaacgtgaccaaaatatgatgttaaaatcagcaactctttatacgttaaaaactttgaaacctgtggccgggcatggtggctcgcgcctgtaatcccagcactttgggaggccaaggcaggtggatcacctgaggtcaggagctcaagaccagcctgaccaacatggtgaaaccccgtctctactaaaaatacaaaaattagctgggcatggtggcgcatgcctataatcccagctactcggaggctgaggcaggataatcgcttgaaaccgggagacagaggttgtggtgagccgagatcacgccattgcactccagccggggcaacaagagcaaaacttcatctcaaaaaaaaaaaaaaaagaaaaaggaaaaaaacaaacaaacaacaactttgaaacctaggaacaattttggacctgttggagcagaaatgtgtagttgtcattgaaggtgtgaacataccctacctctactctacatgtggaagacctgacccacagaggacatgaacccatgaagaagagtgatgtgacatgttttgcattttattagtaccatgatctaaccaactgagctaactggccacaccattttatcctttataatgatcactatgagggctgagtgcagaatggagtgtatgtggtcaagagtggaagctgtgaggctattgcagtaatccagaaagaaaggtgacaatggcttagacttcagtggtagtgttggaaatggacataaatagacatattcaggaaatatattgatcttagatctaataagacacgtaatagattagaagtagggaaattaatgaaaaagcagaattaaggatgacttctcactggcttgaaatgctaaatggatgacggtgctgtttagtgagttggggaagactgggcgtggtgatgggtgtagaaattgagaaaggaaaatcaagaatttccagaactttcagagcaatgttaaatactttccttgatagtgggtcagtcatcatttataagtgcatttctaaaaatattgcttaattttgtttttgagctttgtataagtggaattttgtgtgtactgattattttgctcaatactatgtctttaagattctctgtattgttgcatgtggctgagtttatttttgatgctgtgtagtgttttactaattaataaatcataattcagtttttactgttctattgatgg

SEQ ID NO: 180246 - DNA, 1201 bp, Homo sapiens
  Payload ID: 15507
  Gene Symbol: SRSF9
  Gene Name: serine/arginine-rich splicing factor 9
  Uniprot ID: Q13242
  ENST ID: ENST00000229390
  CDS Start-End: 185-850
cgcagccgcgttctctttaagaggactccttttgcctccgccgaccccttcgcttccgctccgcgttcccacaatgcagtgcggctgagcgcctcggagcccgcggggacgctgcggggggacccgtgctgaggcggcggcggcgacgtgggctgcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctgtctttgtgggttgctctactatggagatcaacagttactgtgactgagtcggcccattctgtttagaaatatattttaaatgtttagtaattga

SEQ ID NO: 180247 - DNA, 327 bp, Homo sapiens
  Payload ID: 15507
  Gene Symbol: SRSF9
  Gene Name: serine/arginine-rich splicing factor 9
  ENST ID: ENST00000550458
  CDS Start-End: 1-327
cgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaact

SEQ ID NO: 180248 - DNA, 1043 bp, Homo sapiens
  Payload ID: 15507
  Gene Symbol: SRSF9
  Gene Name: serine/arginine-rich splicing factor 9
  ENST ID: ENST00000603963
  CDS Start-End: 31-390
gcggcgggcccgcggcgtcgggcggtgcggatgtcgggctgggcggacgagcgcggcggcgagggcgacgggcgcatctacgtggggaaccttccgaccgacgtgcgcgagaaggacttggaggacctgttctacaagtacggccgcatccgcgagatcgagctcaagaaccggcacggcctcgtgcccttcgccttcgtgcgcttcgaggacccccgagatgcagaggatgctatttatggaagaaatggttatgattatggccagtgtcggcttcgtgtggagttccccaggacttatggaggtcggggtgggtggccccgtggtgggaggaatgggcctcctacaagaagatctgatttccgagttcttgtttcagaaaactattaggaaatggctgcagtcctgagctgtgagcggtaaacacagcctttgagagcaggagcacatttccctttcatgacatcaggacttcctccgtcaggcagctggcaggacctgaaggatcacatgcgagaagctggggatgtctgttatgctgatgtgcagaaggatggagtggggatggtcgagtatctcagaaaagaagacatggaatatgccctgcgtaaactggatgacaccaaattccgctctcatgagggtgaaacttcctacatccgagtttatcctgagagaagcaccagctatggctactcacggtctcggtctgggtcaaggggccgtgactctccataccaaagcaggggttccccacactacttctctcctttcaggccctactgagacaggtgatgggaattttttctttattttttaggttaactgagctgctttgtgctcagaatctacattccagattgaggatttagtgtcttaggaaatttttttaattttttttttttaaagaagaaaaaaaactacataatttctaccagggccatattagcagtgaaacattttaaactgcagaaattgtggttttggttcagaaacaagttgtatatttttcacccctgattatgggaaaaaaatcagttctg

SEQ ID NO: 180249 - DNA, 6060 bp, Homo sapiens
  Payload ID: 15508
  Gene Symbol: STK10
  Gene Name: serine/threonine kinase 10
  Uniprot ID: O94804
  ENST ID: ENST00000176763
  CDS Start-End: 345-3251
cggtgggcgggcgcggggacggtcccctggaacgggtccgaggctctcgcaggcagggctgggccgggcaggagctgcgaggccggcacaagggaggcggccctggggacctgacagggcgggggcgggggcgggcacgccgccgcctgcgcggttccgggtgctcccggcgcggcgctgcccagggcacacttgaccgaggtcgggctgcggggaaaggcgggtctggggagaaccccgagagacgcggcgtcctccaactcctcctccttctcctcgcggccgccgaagccacagcccgagcccgagcccgagcccgagccggcgccaccgcgcccccggccatggcttttgccaatttccgccgcatcctgcgcctgtctaccttcgagaagagaaagtcccgcgaatatgagcacgtccgccgcgacctggaccccaacgaggtgtgggagatcgtgggcgagctgggcgacggcgccttcggcaaggtttacaaggccaagaataaggagacgggtgctttggctgcggccaaagtcattgaaaccaagagtgaggaggagctggaggactacatcgtggagattgagatcctggccacctgcgaccacccctacattgtgaagctcctgggagcctactatcacgacgggaagctgtggatcatgattgagttctgtccagggggagccgtggacgccatcatgctggagctggacagaggcctcacggagccccagatacaggtggtttgccgccagatgctagaagccctcaacttcctgcacagcaagaggatcatccaccgagatctgaaagctggcaacgtgctgatgaccctcgagggagacatcaggctggctgactttggtgtgtctgccaagaatctgaagactctacagaaacgagattccttcatcggcacgccttactggatggcccccgaggtggtcatgtgtgagaccatgaaagacacgccctacgactacaaagccgacatctggtccctgggcatcacgctgattgagatggcccagatcgagccgccacaccacgagctcaaccccatgcgggtcctgctaaagatcgccaagtcggaccctcccacgctgctcacgccctctaagtggtctgtagagttccgtgacttcctgaagatagccctggataagaacccagaaacccgacccagtgccgcgcagctgctggagcatcccttcgtcagcagcatcaccagtaacaaggctctgcgggagctggtggctgaggccaaggccgaggtgatggaagagatcgaagacggccgggatgagggggaagaggaggacgccgtggatgccgcctccaccctggagaaccatactcagaactcctctgaggtgagtccgccaagcctcaatgctgacaagcctctcgaggagtcaccttccaccccgctggcacccagccagtctcaggacagtgtgaatgagccctgcagccagccctctggggacagatccctccaaaccaccagtcccccagtcgtggcccctggaaatgagaacggcctggcagtgcctgtgcccctgcggaagtcccgacccgtgtcaatggatgccagaattcaggtagcccaggagaagcaagttgctgagcagggtggggacctcagcccagcagccaacagatctcaaaaggccagccagagccggcccaacagcagcgccctggagaccttgggtggggagaagctggccaatggcagcctggagccacctgcccaggcagctccagggccttccaagagggactcggactgcagcagcctctgcacctctgagagcatggactatggtaccaatctctccactgacctgtcgctgaacaaagagatgggctctctgtccatcaaggacccgaaactgtacaaaaaaaccctcaagcggacacgcaaatttgtggtggatggtgtggaggtgagcatcaccacctccaagatcatcagcgaagatgagaagaaggatgaggagatgagatttctcaggcgccaggaactccgagagcttcggctgctccagaaagaagagcatcggaaccagacccagctgagtaacaagcatgagctgcagctggagcaaatgcataaacgttttgaacaggaaatcaacgccaagaagaagttctttgacacggaattagagaacctggagcgtcagcaaaagcagcaagtggagaagatggagcaagaccatgccgtgcgccgccgggaggaggccaggcggatccgcctggagcaggatcgggactacaccaggttccaagagcagctcaaactgatgaagaaagaggtgaagaacgaggtggagaagctcccccgacagcagcggaaggaaagcatgaagcagaagatggaggagcacacgcagaaaaagcagcttcttgaccgggactttgtagccaagcagaaggaggacctggagctggccatgaagaggctcaccaccgacaacaggcgggagatctgtgacaaggagcgcgagtgcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttgtcacctgaacctaatgtatattctccttgagccccagatcccttcaagctggaagggatggggctgttggtggggtcagggtccaagaggaatgggtgttctgtggcctcgagtcctctcctgtttgcgaaaataccagttttgctctctgtgggacaaagcactgctgatgaagtccccgtgggctcatccgggctggaattcttggtttttcagccattccctgcagagtcactcaatcatcaagtccctcacagccatttctgttcccagaggagccaggcctgcagctggctgctcaggagatggcctcattcctcctgttctcccagtttgctttccacttaagacaaagccttgtctatgtggggggcggggaccggggaaagagggaggctgaaatgtttattctgcttctcccgtgtttcatgccatctcgcgtcccccttcctgcacatgggtgtgaatgcacacacatacgcgtacacacaggacttggtctgctggcctggcctcttctgcccaggtgggttggaacacgtttgctgcctgagcctgtgccactgagcatgttaggtggagcagttggtgtggcacgtgcggggtgttggcaccggaggcatggaaaagcacaggctgtactgccaggctgcgatgcgtgctggcccccgcacaggctcctgtgtgcagggactgattcctcagcacacgaggcttccacaacccagtctgctccatagcactctggcccaccctgtctgcaggtgaaacaggagggctgtttgcctctgccccatccccccgactgtgttcaggagtcccaccttgcatttcagacctgggctggcagtctgttggacttctcttcaggaagaaaaagcatcagggggaaatggaatgcccctgccccaggaacatggcagaagcacaggttctgtacctcagatggactcctgctgggccttcggggtctcagttggcttcccccagattctgattctacagctgcagaatgtatataacgcaataaaagcaaatgtttgaaccagtatgcgggtttacttacaaggaaaccttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaaattctttgagacagggtctctaatatgttgcccaagctgatctcaaactcgtggctcaactgattctcccgcttcaaccttgagtagctgggacgacagatacatgctactgcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggttatttgcc

SEQ ID NO: 180250 - DNA, 994 bp, Homo sapiens
  Payload ID: 15508
  Gene Symbol: STK10
  Gene Name: serine/threonine kinase 10
  ENST ID: ENST00000520476
  CDS Start-End: 1-845
gcctcatgaagaagcaggagctccttcgagaccgggaagcagccctgtgggagatggaagagcaccagctgcaggagaggcaccagctggtgaagcagcagctcaaagaccagtacttcctccagcggcacgagctgctgcgcaagcatgagaaggagcgggagcagatgcagcgctacaaccagcgcatgatagagcagctgaaggtgcggcagcaacaggaaaaggcgcggctgcccaagatccagaggagtgagggcaagacgcgcatggccatgtacaagaagagcctccacatcaacggcgggggcagcgcagctgagcagcgtgagaagatcaagcagttctcccagcaggaggagaagaggcagaagtcggagcggctgcagcaacagcagaaacacgagaaccagatgcgggacatgctggcgcagtgtgagagcaacatgagcgagctgcagcagctgcagaatgaaaagtgccacctcctggtagagcacgaaacccagaaactgaaggccctggatgagagccataaccagaacctgaaggaatggcgggacaagcttcggccgcgcaagaagatggagtctcgcaccgtcgcccaagttggagtgcagtggcgcaatctcaactcaggctctggaagaggatctgaaccagaagaagcgggagcaggagatgttcttcaagctgagcgaggaggcggagtgcccaaacccctccaccccaagcaaggccgccaagttcttcccctacagttctgcggatgcttcttaacaaccgcccggggctgtggctggcagcttggtgggccccagggccttctccttcattctctgtgaacatgtaactcaggaccccttttccctcttgcgtctgtgccagctcaaatccagcccctcgccctgtgccaccccaactgtgcctgatagacctgccccagcgttcctgacttcttgctggcctgtggagggtgaggtgtaattatttg

SEQ ID NO: 180251 - DNA, 2611 bp, Homo sapiens
  Payload ID: 15509
  Gene Symbol: STK11
  Gene Name: serine/threonine kinase 11
  Uniprot ID: Q15831
  ENST ID: ENST00000326873
  CDS Start-End: 451-1752
ggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggagggccgggcccccaaccctgcccgcaaggcctgctccgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttgagctgtggctgtgaggggtgtttgggagctgctgggtggcaggggggctgtggggtcgggctcacgtcgcggccgcctttgcgctctcgggtcaccctgctttggcggcccggccggagggcaggaccctcacctctcccccaaggccactgcgctcttgggaccccagagaaaacccggagcaagcaggagtgtgcggtcaatatttatatcatccagaaaagaaaaacacgagaaacgccatcgcgggatggtgcagacgcggcggggactcggagggtgccgtgcgggcgaggccgcccaaatttggcaataaataaagcttgggaagcttggacctg

SEQ ID NO: 180252 - DNA, 637 bp, Homo sapiens
  Payload ID: 15509
  Gene Symbol: STK11
  Gene Name: serine/threonine kinase 11
  ENST ID: ENST00000593219
  CDS Start-End: 99-404
tttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaactcctggccactctgaatccacttcctggctctggattggcttgtcctggatattgcatagaaatgggatcctgtcggccgggcgcggtgactcacgagagcaagagatccagaccatcctggccaacatgggaaattcaactactgaggaggttacggcacaaaaatgtcatccagctggtggatgtgttatacaacgaagagaagcagaaaatgtatatggtgatggagtactgcgtgtgtggcatg

SEQ ID NO: 180253 - DNA, 2777 bp, Homo sapiens
  Payload ID: 15509
  Gene Symbol: STK11
  Gene Name: serine/threonine kinase 11
  ENST ID: ENST00000586243
  CDS Start-End: 961-2259
cgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaaggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaagcgtttcccagtgtgccaggcccacgggtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccggaccagccagggctccccggctttccagccgcccgagattgccaacggcctggacaccttctccggcttcaaggtggacatctggtcggctggggtcaccctctacaacatcaccacgggtctgtaccccttcgaaggggacaacatctacaagttgtttgagaacatcgggaaggggagctacgccatcccgggcgactgtggccccccgctctctgacctgctgaaagggatgcttgagtacgaaccggccaagaggttctccatccggcagatccggcagcacagctggttccggaagaaacatcctccggctgaagcaccagtgcccatcccaccgagcccagacaccaaggaccggtggcgcagcatgactgtggtgccgtacttggaggacctgcacggcgcggacgaggacgaggacctcttcgacatcgaggatgacatcatctacactcaggacttcacggtgcccggacaggtcccagaagaggaggccagtcacaatggacagcgccggggcctccccaaggccgtgtgtatgaacggcacagaggcggcgcagctgagcaccaaatccagggcggaggccgggcccccaaccctgcccgcaaggcctgctgccagcagcaagatccgccggctgtcggcctgcaagcagcagtgaggctggccgcctgcagcccgtgtccaggagccccgccaggtgcccgcgccaggccctcagtcttcctgccggttccgcccgccctcccggagaggtggccgccatgcttctgtgccgaccacgccccaggacctccggagcgccctgcagggccgggcagggggacagcagggaccgggcgcagccctcccccctcggccgcccggcagtgcacgcggcttgttgacttcgcagccccgggcggagccttcccgggcgggcgtgggaggagggaggcggcctccatgcactttatgtggagactactggccccgcccgtggcctcgtgctccgcagggcgcccagcgccgtccggcggccccgccgcagaccagctggcgggtgtggagaccaggctcctgaccccgccatgcatgcagcgccacctggaagccgcgcggccgctttggttttttgtttggttggttccattttctttttttctttttttttttaagaaaaaataaaaggtggatttg

SEQ ID NO: 180254 - DNA, 505 bp, Homo sapiens
  Payload ID: 15509
  Gene Symbol: STK11
  Gene Name: serine/threonine kinase 11
  ENST ID: ENST00000585851
  CDS Start-End: 46-505
gcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtacttctgtcagctgattgacggcctggagtacctgcatagccagggcattgtgcacaaggacatcaagccggggaacctgctgctcaccaccggtggcaccctcaaaatctccgacctgggcgtggccgaggcactgcacccgttcgcggcggacgacacctgccgga

SEQ ID NO: 180255 - DNA, 746 bp, Homo sapiens
  Payload ID: 15509
  Gene Symbol: STK11
  Gene Name: serine/threonine kinase 11
  ENST ID: ENST00000585748
  CDS Start-End: 682-746
ggcaacagcaaagcatcacgctgagcgccgggaccttctgagtgcaggcggtgggcgaagccccgagtcacacacacccacgacgccggccctgctcccacagcggccctctggggtagcgactggtattacctgcatttcacgagggaggaaactgaggcacgaactgttcagaagctgccctgaggtcaccaagtgagctaggaagaggcgtgggctcgatctctgccacatccacctcgggaaaccacaaggtcctcctaaatgtcttcccagccccttcgagagaattgtggaagtggggttgccagatcaaacacaagacacccagttaaaattcaactgtaggcaaggattcagggacatctcagagccgctggggtctcgtcggtaaagtggtggtggacggcatggaggaactttagccctggaccagaaactttaggtcagtctatgtcagccattgttgctatcagccttcaggtcgtctgggctgggaggtctcctccctcttcctccaggcaccagtgggagcaggcagtcacaccttcctgtgagtgagaaccatagcagaaccttcaaagcacctctcaagtcggggaaattcaactactgaggaggttacggcacaaaaatgtcatccagctggtggatgtgttatacaacgaagagaagcagaaaatgtatatggtgatggagtactgcgtgtgtggcatgcaggaaatgctggacagcgtgccggagaa

SEQ ID NO: 180256 - DNA, 3601 bp, Homo sapiens
  Payload ID: 15510
  Gene Symbol: STK11IP
  Gene Name: serine/threonine kinase 11 interacting protein
  Uniprot ID: Q8N1F8
  ENST ID: ENST00000295641
  CDS Start-End: 44-3343
gataggcgccgggcagctgagctggtaggaggaccagacggggaggttcggctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 180257 - DNA, 3615 bp, Homo sapiens
  Payload ID: 15510
  Gene Symbol: STK11IP
  Gene Name: serine/threonine kinase 11 interacting protein
  ENST ID: ENST00000456909
  CDS Start-End: 91-3357
tcctttccatcattgataggcgccgggcagctgagctggtaggaggaccagacggggaggttcggctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagaggagctcctctcagcctgcggcggcgacttctgctctgccctcccttggctggctctgctttctgccaacttcagctacaatgcactgaccgccttagacagctccctgcgcctcttgtcagctctgcgtttcttgaacctaagccacaatcaagtccaggactgtcagggattcctgatggatttgtgtgagctccaccatctggacatctcctataatcgcctgcatttggtgccaagaatgggaccctcaggggctgctctgggggtcctgatactgcgaggcaatgagcttcggagcctgcatggcctagagcagctgaggaatctgcggcacctggatttggcatacaacctgctggaaggacaccgggagctgtcaccactgtggctgctggctgagctccgcaagctctacctggaggggaaccctctttggttccaccctgagcaccgagcagccactgcccagtacttgtcaccccgggccagggatgctgctactggcttccttctcgatggcaaggtcttgtcactgacagattttcagactcacacatccttggggctcagccccatgggcccacctttgccctggccagtggggagtactcctgaaacctcaggtggccctgacctgagtgacagcctctcctcagggggtgttgtgacccagcccctgcttcataaggttaagagccgagtccgtgtgaggcgggcaagcatctctgaacccagtgatacggacccggagccccgaactctgaacccctctccggctggatggttcgtgcagcagcacccggagctggagctcatgagcagcttccgggaacggttcggccgcaactggctgcagtacaggagtcacctggagccctccggaaaccctctgccggccacccccactacttctgcacccagtgcacctccagccagctcccagggccccgacactgcacccagaccttcacccccgcaggaggaagccagaggcccccaggagtcaccacagaaaatgtcagaggaggtcagggcggagccacaggaggaggaagaggagaaggaggggaaggaggagaaggaggagggggagatggtggaacagggagaagaggaggcaggagaggaggaagaagaggagcaggaccagaaggaagtggaagcggaactctgtcgccccttgttggtgtgtcccctggaggggcctgagggcgtacggggcagggaatgctttctcagggtcacttctgcccacctgtttgaggtggaactccaagcagctcgcaccttggagcgactggagctccagagtctggaggcagctgagatagagccggaggcccaggcccagaggtcgcccaggcccacgggctcagatctgctccctggagcccccatcctcagtctgcgcttctcctacatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaatctcctgctgtgtgtcctaactgtggtagtgaccacgtggttctcctcgctgtgtctcggggaacccccaacagggagcggaaacagggagagcagtctctggctccttctccgtctgccagccctgtctgccaccctcctggccatggtgaccaccttgacagggccaagaacagcccacctcaggcaccgagcacccgtgaccatggtagttggagcctcagtcccccccctgagcgctgtggcctccgctctgtggaccaccgactccggctcttcctggatgttgaggtgttcagcgatgcccaggaggagttccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgtcccggctggagagcttttgggcactccgtgtggtgtgtcaggagcagctgacagccctgcttgcctggatccgggaaccatgggaggagctgttttccatcggactccggacagtgatccaagaggcgctggcccttgaccgatgagggtcccacgctgaccttggccctgacctcaggagccacgctgtagacattccctctcctggtctctgggtctggcttccaggctctggctgtggatgtcttcagcctctgggtgctggccagtgaggtcccaaatgacccagggcttaagggagaggcgagagaatgatctggcctcaggggacaggccacctggtcaggaggaatatttttcctgcactttttctcaggtatcaataaagttgtttccaactcata

SEQ ID NO: 180258 - DNA, 578 bp, Homo sapiens
  Payload ID: 15510
  Gene Symbol: STK11IP
  Gene Name: serine/threonine kinase 11 interacting protein
  ENST ID: ENST00000456857
  CDS Start-End: 27-359
gctccgccccccagcgtcccgtggccatgacgaccgctcagagggactccctgttgtggaagctcgcggggttgctgcgggagtccggggatgtggtcctgtctggctgtagcaccctgagcctgctgactcccacactgcaacagctgaaccacgtatttgagctgcacctggggccatggggccctggccagacaggctttgtggctctgccctcccatcctgccgactcccctgttattcttcagcttcagtttctcttcgatgtgctgcagaaaacactttcactcaaggttctgggtgtggggaagaggcaggatgtgcaaggagcccaagagaatgatggaagttggggatagggtaggggtgcagaagtctgcagtgccaggatccagagggtgtcagagctggtccatgttgctggtcctggccccacagggcccatcaagattttccccttcaaatcccttcggcacctggagctccgaggtgttcccctccactgtctgcatggcctccgaggcatctactcccagctggagaccctgatttgcagcaggagcctccaggcattagag

SEQ ID NO: 180259 - DNA, 880 bp, Homo sapiens
  Payload ID: 15510
  Gene Symbol: STK11IP
  Gene Name: serine/threonine kinase 11 interacting protein
  ENST ID: ENST00000413891
  CDS Start-End: 1-598
ccagtgctgcctcaaggtgccagtggcattggcaggccacactggggagttcatgtgccttgtggttgtgtctgaccgcaggctgtacctgttgaaggtgactggggagatgcgtgagcctccagctagctggctgcagctgaccctggctgttcccctgcaggatctgagtggcatagagctgggcctggcaggccagagcctgcggctagagtgggcagctggggcgggccgctgtgtgctgctgccccgagatgccaggcattgccgggccttcctagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggtgaagcctctgtgcagctgatgcttccctggtctctgtaccctaccttgtcacaggcactggcccacgcgcagcacctgtacagtgcccttgcagcaactgtcagttcctggaacctggagaacctctcacttgagggcatagctgagtaacagcctcagtgtgccctgaccctctgggtggggttaggaggcacccaggatcctcagttacccagagcctttgctctcgggcccaggctttctatgaagtggagcagcgtggctgagtcggccctgcctcatcagtcacagaaggagagggtggagccttgtttctgagtagggcccttccacctgcctcgtatccctgttgctgactccgtccaccctgttcctgttagatgaggatgctgcagggtccccggcagagccctctcctccagcagcatctgg

SEQ ID NO: 180260 - DNA, 705 bp, Homo sapiens
  Payload ID: 15510
  Gene Symbol: STK11IP
  Gene Name: serine/threonine kinase 11 interacting protein
  ENST ID: ENST00000447191
  CDS Start-End: 1-500
tagaggagctccttgatgtcttgcagtctctgccccctgcctggaggaactgtgtcagtgccacagaggaggaggtcaccccccagcaccggctctggccattgctggaaaaagactcatccttggaggctcgccagttcttctaccttcgggcgttcctggttgaaggcccttccacctgcctcgtatccctgttgctgactccgtccaccctgttcctgttagatgaggatgctgcagggtccccggcagagccctctcctccagcagcatctggcgaagcctctgagaaggtgcctccctcggggccgggccctgctgtgcgtgtcagggagcagcagccactcagcagcctgagctccgtgctgctctaccgctcagcccctgaggacttgcggctgctcttctacgatgaggtgaggaagctgaggcttggggatgttaaccagtttgcccagtccaaagtggtggagccgggaattgaatccacagttccctgaaattgagcccgcatcttctgtacaacagggaagatgaaaaagacaggtcctctggaggctttcagtaaacgtcggctggattctgtttacaaagctcagagtcaggatcttttatggggagtgacatgggcctggggaaggggagaggcactgagccaaggtggagacagtgaggccttcgcagagacctcccttgtacccaccc

SEQ ID NO: 180261 - DNA, 305 bp, Homo sapiens
  Payload ID: 15510
  Gene Symbol: STK11IP
  Gene Name: serine/threonine kinase 11 interacting protein
  ENST ID: ENST00000483319
  CDS Start-End: 1-290
acatctgccctgaccggcagttgcgtcgctatttggtgctggagcctgatgcccacgcagctgtccaggagctgcttgccgtgttgaccccagtcaccaatgtggctcgggaacagcttggggaggccagggacctcctgctgggtagattccagtgtctacgctgtggccatgagttcaagccagaggagcccaggatgggattagacagtgaggaaggctggaggcctctgttccaaaagacagaccagtcagcactatctttgaagaagacattgaagaagaaataaatattcttgataaca

SEQ ID NO: 180262 - DNA, 1673 bp, Homo sapiens
  Payload ID: 15511
  Gene Symbol: STK16
  Gene Name: serine/threonine kinase 16
  Uniprot ID: O75716
  ENST ID: ENST00000396738
  CDS Start-End: 423-1340
agcactgcttccggtcggtggcgcttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaa

SEQ ID NO: 180263 - DNA, 895 bp, Homo sapiens
  Payload ID: 15511
  Gene Symbol: STK16
  Gene Name: serine/threonine kinase 16
  ENST ID: ENST00000409516
  CDS Start-End: 145-708
ctgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaagggg

SEQ ID NO: 180264 - DNA, 1069 bp, Homo sapiens
  Payload ID: 15511
  Gene Symbol: STK16
  Gene Name: serine/threonine kinase 16
  ENST ID: ENST00000409743
  CDS Start-End: 105-926
catgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcagtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatctt

SEQ ID NO: 180265 - DNA, 2868 bp, Homo sapiens
  Payload ID: 15511
  Gene Symbol: STK16
  Gene Name: serine/threonine kinase 16
  Uniprot ID: O75716
  ENST ID: ENST00000409638
  CDS Start-End: 173-1090
acgccggcgcggactgatgatgtcagcactgcttccggtcggtggcgcttctctctggcccgagccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagatcttagtctcagtgttcctggagtgagagaagaggtgcaaggggcccaaagtcaggttgccatttcaggcgaactgcctgggaaggaggaatggtgcagagtcggcaatggtgtgacttcattctacaggaggttggttagcagtggacagttctagcttgtcttagatcaaaacttaaagctgcttgggctcaagctggcatctgcctgtgtcaagaactagggccccctaaaaacactcaactagttctttccttccttcactcctggggtgagtagcttagtcaaagctgcctagccggtttgctaggcaagggcctctgggtggagacacctgaggaagctttgagacaggtagattacaggtctcccatcctcagcctaggggcgaggggagtggaggtggcagcggcagctgttttggcctgtgtctccctgatcgttcaagctcatacatggttaatgattaatgaggcagtgtggtgtggcagtatccagctgccacttcctgcctactctgctgagtaaacaggggccctgtcttagctgggcttcaaacctgttccctagggaagggctctgttccctgaatcaccagggaggaaaggcaagggcagggttggcatctcctgctcttttgtgatccaagcctcctcccccgaaccatgtctaccccacagtatgacatcagcatggggcctggggctcctgttagcaaagttgaagctttccccagggccctagcaggagtctcccactagctagcacagaggctgaggccagaaagaaatcacaaacagaggggagatgacctgacttttaatggcacagccccagctccagcaaagcagcaagacaggaagctatgcaaagctgctcagaggtgcagtggcacaaacaactctaggagatcgcctgtgttccctcccatcccccaagcttatgacgtggctccatgcccaggaactctgggccagcccagccccactcccaaaccctcataatgcacagaggagcctgggccaagccttgcttccagagttggtaaatgtagaggcagcaggaagaacagggtagcagtctaactttcaaagacagaaaccactggattatactcctacttggaaaggagctgaagactcatccttcaacagtttgtgcctggattttggtcctcatttcctccctatactgagtaaccctaggacttcaatttaaagtccctggggttatgcttcctgggcctggcaagaacccctttgcaggtctcaccttcagcgatggaagggataagggtcatgaacagcaaacagagcagcagcagcatgaaggggaaggcagcagaagctcaagcactcagagggaacaagaaaccgtgcaaggaaactgtttatttcgaaaggattttgcaataaacatagtgaataggc

SEQ ID NO: 180266 - DNA, 1493 bp, Homo sapiens
  Payload ID: 15511
  Gene Symbol: STK16
  Gene Name: serine/threonine kinase 16
  ENST ID: ENST00000409260
  CDS Start-End: 109-1161
ccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggagggatttctcttagagccacatcttgggaaggtttctgctaaatgggaaggacaccccactccccaccaggaaatttctctaggtccaagccatgtgggagatgaccatggccctttattgacccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaagagaggtacgctgtggaatgagatagaaaggctgaaggacaaaggcaacttcctgaccgaggatcaaatcctttggctgctgctggggatctgcagaggccttgaggccattcatgccaagggttatgcccacagagacttgaagcccaccaatatattgcttggagatgaggggcagccagttttaatggacttgggttccatgaatcaagcatgcatccatgtggagggctcccgccaggctctgaccctgcaggactgggcagcccagcggtgcaccatctcctaccgagccccagagctcttctctgtgcagagtcactgtgtcatcgatgagcggactgatgtctggtccctaggctgcgtgctatatgccatgatgtttggggaaggcccttatgacatggtgttccaaaagggtgacagtgtggcccttgctgtgcagaaccaactcagcatcccacaaagccccaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtgga

SEQ ID NO: 180267 - DNA, 3368 bp, Homo sapiens
  Payload ID: 15512
  Gene Symbol: STK17A
  Gene Name: serine/threonine kinase 17a
  Uniprot ID: Q9UEE5
  ENST ID: ENST00000319357
  CDS Start-End: 180-1424
gcggggcgcggggcgggcccgagctaccggtagtctgcctgccgcagtccgagcgccgcgctggggagagcgggtgtttgaaggctccgcggaccggcactaggagccgggggcgggtccgtgaccctccggctgctcggagtgaacaggcggccaggaaagaagcgggcctgaacaccatgatccctttggagaagccaggcagcggcggctcctccccaggcgccacctcaggctcgggccgggcaggccggggtctgagcgggccgtgccggccgccgccgccgccccaggcccgcgggctgctgacagagatacgcgccgtggtgcgcaccgagcccttccaggacggctacagcctgtgcccgggccgggagctgggcagggggaaatttgcagtggtgagaaaatgtataaagaaagattctgggaaagaatttgctgcaaagttcatgagaaaaagaagaaaaggccaagattgtcggatggaaataattcatgagattgctgtacttgaactagcacaagacaatccttgggtcattaatttacatgaagtttatgagactgcatcagaaatgatcttagttctggaatatgctgctgggggtgaaatctttgaccagtgtgttgcagacagagaagaagcctttaaagaaaaagatgttcaaagacttatgcgacagattttagaaggtgttcactttttacacactcgtgatgtagttcatcttgatttgaagcctcagaatattctgttgacaagtgaatctccattgggtgacattaagattgttgattttggcctttcaagaatattgaagaacagtgaagagctccgagaaattatgggtacccctgaatatgtggctcctgaaattcttagttatgatcctataagcatggcaacagatatgtggagcattggagtgttaacatatgtcatgcttacaggaatatcacctttcttaggcaatgataaacaagaaacattcttaaacatctcacagatgaatttaagttattctgaggaagaatttgatgttttgtctgagtcggctgttgatttcatcaggacacttttagttaagaaacctgaagatcgagccactgctgaagaatgtctaaagcacccctggttgacacagagcagtattcaagagccttctttcaggatggaaaaggcactagaagaagcaaatgccctccaagaaggtcattctgtgcctgaaattaattcggataccgacaaatcagaaaccaaggaatccattgtaaccgaagagttaattgtagttacttcatatactctaggacaatgcagacagtctgaaaaagagaaaatggagcaaaaggccatttccaaacgatttaaatttgaggaacctttgctacaagaaattccaggagaatttatctactgagcaatatttccctttagaacttcaagatttctacattgaaaatgttaatattatttatggacctctggccaaatggtacatgtactggaagtggataaccagtatcacttacacaaacaaaaataactttgtcaaatttgtggagttaggtggaagccagattttaaaagttgccaaccaggagatttaacaggtacagttacccgtttcaatgttatttttaagaagggagatgttggcacctttgaattctacatcctgtttctccagaatgagaatttgtgtacaaagatatttgtattcactttctttaaaaaatccaagtaaaagtgccaaaactacacttctgtaaatctcttgcattattcatatgtgtatctatatctgcataatgtttgttaatgtctactaaaattgctactttttcactttggatttgtttttggcaaaattttagtctaaacagacatctaaattttcgagacttagaataacattcactaaagtttgataatgtcttttttaaatattttcttactgctttatagtgacttgatttggtttctgttgtgtttttgcctaaatactagtaacatatcagtgaaaaaccctaattttttttctcttcaatgtcactagtaagagaggtggtaatttttcacctctgaaattattctgggtttaggtgtcagctcttgagctgcttccctcatcacaccacactcacatgcatctgttctctctcacactctatacccctgccacttcctggcacctccccccatgcttgtcatttaattttggccacttgtaggtatcagtgtgatctgatcaacactctggttaccttggtcagtgaaaagatgctactatattgcttttgtcccaaagtgagtaaaatcccctagagcagagagagagagagagagagagagtgtcttcatgccaaccacagcctgtttctgctgagtttcttatcagccctcaagctatgctaggaaaagttataaaatgccaaaatatttataaacatttactttgtccataaaaaatttacattggatactctgtaagtaggaggtactttgtcccaaaaagatgtataagaatgtactaatagttttatttgattaggattgaacagttcagttgtatctatgccccacagtgaccagtaaagtccaattaaaatatggaaatgtaaaagtgtatgccgaataccttaaagtaactaattatccttacacacaaaaggctcagtgcattaaatatttgcctatcacctgtgtgctgtgtaccgtggccatgcctcgctctgcactatgaacaactcagacctgtcccttcacggtctgattagggtgtcacacaaagctctctccctaacatggtttctcaactgtcaaaatcatgaaaatgacagcacctaaccactattttaaagtatgtacagtaaatacccaaatgtgtgtaaatgtcatagacatatacaaagtcagtaatctcacccagtcctgctgtgtgaacctgtcaaagcacctgggagtgccctttacaccattaggtgaaattcatcaggcacttcagacaaccaggttgcactgttttctcactaaattggctttatttatacagtttcctggaacctagcattcctaaacaagctccaaaatgcagaagaagaaattgtgccacagtgatagagtttttaatgaatatccatggccacagttttgagtctcaggtaagtcttggaagaagttaaacacagtattaggcaaatatttatctctctgaaaaaatagggaggaggtgaccaggaaaaaataaccactattgaatgacacgtttgtacttgatggatctgtcatcaagttttaaaatcagaatcatttgggctttttaaaaaccattttatactcgtaataaatatatttaatataa

SEQ ID NO: 180268 - DNA, 5287 bp, Homo sapiens
  Payload ID: 15513
  Gene Symbol: STK17B
  Gene Name: serine/threonine kinase 17b
  Uniprot ID: O94768
  ENST ID: ENST00000263955
  CDS Start-End: 288-1406
ccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtcccgggagaacctgcggcggccggagcggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttagcacttttttctttgactcatttggactgaatttgaaattttatatccactccagtgagattatgatttgtagcttcatatatgacatgtttatattgtaaatgcacttttccatggaataatttagggaagtgttttaatgttaaattactagttgctagcatgttatgatttcatatcctgagatagctctgcagataagaaaatatttaaatatatgacaaaaagtaaaattgtacatgtgagtttacatgttaatgaaataattcaacttcaaatgaacttaccagaatgttttgcatatcaacaaaaaaagtggcttgagttttattatagttggtgtaaactgaacacagtgaagacattggaatttaataggttctctctctaaggtgactcttataccatgcctctatcaacataatttgtttaggaaagcagtatgaagtttaagccaaaataatttctactttatagatgctcaagagacattttacaattgaaaatgtctttcaattacaaatattttgaaacttcgtaagattttcattctctgtggtctgttatatgagagagatcctttaactagagcaaagagggagttagaaacctgatcagggatattctttacaagttggagcagaggaaagagtagcatgccttcgtattttaacgcaaatgtctttttcctcctcccaacctacttgagatctgataaggtctggaagatggagatatttggtatgcaagtgtagagttttttaatcctccagaatttctagagtagaagatacttaggtatagttaaatattctgtatttttagtcaaacatatttattaattgaatatagaagaaaatgttgacacactcagacagcttactgaattttagatgtcttctgcatcttagaatacaagccagtcattcagagttctaaaagtatgcataaaaaattacagcaccggtaggtctattaacacagtgcccgagtcagcggtagcaagactgatgtgatcataaaacatgacatcaggctcgtctgaagttcttgtgtgaaattcctagtgagtgaggaggctcagcttaaagccatctgcagagtggcccctcattgtggtcttttgctgggaccaatgcaagagactagggagagcaaaatgtttgcttatggctagagactatatccagccctaatgatggggaaagttagtccttttcgggtaatcttttatgaattttcacctgatgaccgttatattggtctgttatcatgttacgataactgtgatctcatgaccatgttgctgtatcagaagaaatagtttgacaaatggtaacaacaacctgatgttccccctttagacctttaacttctcaaaattttggtaagtttccaaattctttaataataacttaaaactttttgaataactatcaggtcactttatttgaccacatggtgaattcctttaatgtcttcagcatttgttaaggaaaagttttctctacttgtgtgtgtatgtgtgcacatgtgtgtatgtacaggtgtatgtatatatctatagatagatacaatacattctttagacacttttcaagattctttgctgtggtatattgtgctcaactcaggtgccaaaggagctttttttttttttttttttttttgagatggagttttgctctgtctctcaggctggagtgcagtggcatgatctcagctcacggcaacctctgcctcccgggttcaagcaattctcctgtctcagcctcctgagtagttgggattacaggcgcatgccaccgtgcccagctaatttttgtatttttagtagagacggggtttcaccatgttggccaggctggtcacaaactcctgacttcaagtgatccacccgcctcggcctcccaaagtgctgggattacaggcgtgagccactgcgcccccgcccaggagctcttttcttatgacatataaattatgacatttatattctttatatgactttatgttctcttcttatgacatttaaattctttaagtagtttgttggtccaataaactagacgttgtataatctaaattgagcccttgtatatctaaaactgatgagttgtttctaaattgttgattgtccatttacttgcctttggtattaagataatgcaagtaaagtttagtaagtcattggataatgaaatgattatgtttctgaagaccatattatatttttaatttttagaggaatcatgccatcccccaaaaaatcaagaaatatttgaattttaaattataagttcatttgttaaaagacatttttacaaatgtctgaaaatcttaaaatactttacatctacctttaagtagtagaatacagagctgtaaatttccatgccttttttcctgatattaagttttatagtaaaaaagcaactagtgattgcacaaagaatataaaaatccactctttttacaaaggtgtgaatttaaataacgttattgattggaatatgaaaatagaccaatcatttaagagctttttagcaaatgattcaattcttactctttttctcccaagattgaaaagcataatgtatttctctaaagtaggaatctagagagcccctgtgagtggacaaatgtcagtaacacttgaacacatgagaagataagtgttatgttgtgataatttaaagttaaatttgctttttgggtaggatccctaaatagatgggatttttaaatagatgatatatagatgacaattgcaattgtcattttaattattttccctacagtaaagaacctagctctgagcagtgaaattgtaatggcactttaaaggaagtaagccgttaactgttctctagtggagcgatctccaactgttttggcactagggacgggttttgtggaagaaaatttttccacaggactgggggtttagggggatggtttcaggatgattcaagtacattacatttatcattagattctcataaggagcatgcaacctagatctcttgcacgtgtggttcacagcaggattcgagctcctttgagaatctaatgccatggctgatctaacaggaaactgagctcaggcagtaatgcttggcaccgccccccaccttctatgcagcccggtcgtggcctggggactggggacccctgctctagtcagtaataaggtacttgtgccagaatataaatcaacacattgcttcctttatcaaagaagtcttgttatttaaaaaaagtcaactgagccagtatgattagtgatgtaattgattttcattctggcacaagcctctttcattctggacagctcacaaatagttaatggaccatgctttgaatagccttcctctaagcaacatttataaatactgatattttagaactgtttacatttcttctgtttatttttgaattttcagtttgatatcttgtccttattcattgttgtataaacaactgtactttaatttcaagtagtattaaaagtatttcacttcagtttggggggattattatcaatttataattttataaaagtattttaaagaataattgtaaattttccataaattacaacttcctgccatattttattaaataataatcttgcttaaggcatatagacagacattattatgagtattccagtaaaaaaaatctacatcaacttgaccattctggctaaaaattaaaaagcacttttttatatctgtggttgtcatttgtttcaaagcatttctaaatttattgttcttaaaagtatgtctgcatgttctagcctttgacctaggtcatctatgaaccctctttgtgtctaataaacatatctgtaaaggcatataaatctgaaaacaa

SEQ ID NO: 180269 - DNA, 1441 bp, Homo sapiens
  Payload ID: 15513
  Gene Symbol: STK17B
  Gene Name: serine/threonine kinase 17b
  Uniprot ID: O94768
  ENST ID: ENST00000409228
  CDS Start-End: 323-1441
ctctttctctctcacagcttctcacgaggtagaactttagagcctggtgtgtttgtggctggagcatagcagctcttctacaactttactgtagtttctactgaatattttggtttgcaaatataaaggattctctgaagcacaaccttaaataacgtgtggtagacacctgggagaggaaaactgcagacagaaaaatgtggccggatgctctgtgggcgggcggcagcgatgttcggccaggtggctccaaggagaggaagcagtgatgcattgaggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatatgctgcaggtggagaaattttcagcctgtgtttacctgagttggctgaaatggtttctgaaaatgatgttatcagactcattaaacaaatacttgaaggagtttattatctacatcagaataacattgtacaccttgatttaaagccacagaatatattactgagcagcatataccctctcggggacattaaaatagtagattttggaatgtctcgaaaaatagggcatgcgtgtgaacttcgggaaatcatgggaacaccagaatatttagctccagaaatcctgaactatgatcccattaccacagcaacagatatgtggaatattggtataatagcatatatgttgttaactcacacatcaccatttgtgggagaagataatcaagaaacatacctcaatatttctcaagttaatgtagattattcggaagaaactttttcatcagtttcacagctggccacagactttattcagagccttttagtaaaaaatccagagaaaagaccaacagcagagatatgcctttctcattcttggctacagcagtgggactttgaaaacttgtttcaccctgaagaaacttccagttcctctcaaactcaggatcattctgtaaggtcctctgaagacaagacttctaaatcctcctgtaatggaacctgtggtgatagagaagacaaagagaatatcccagaggatagcagcatggtttccaaaagatttcgtttcgatgactcattacccaatccccatgaacttgtttcagatttgctctgttag

SEQ ID NO: 180270 - DNA, 507 bp, Homo sapiens
  Payload ID: 15513
  Gene Symbol: STK17B
  Gene Name: serine/threonine kinase 17b
  ENST ID: ENST00000420683
  CDS Start-End: 306-507
aggaaaactgcagacagaaaaatgtggccggatgctctgtgggcgggcggcagcgatgttcggccaggtggctccaaggagaggaagcagtgatgcattgagggagtaaacatggaatcggtgagaatcactttccttgatcattatgtggtcagtatgcggtgactgacttgatgtgactggggaaggtcccttccctggacagaatatggtgagtgtcgtgccattaccggagaggatcaccttccctggccacatgtggtaaaaataagtgactaaagaagcagacctgggaatcacctaacatgtcgaggaggagatttgattgccgaagtatttcaggcctactaactacaactcctcaaattccaataaaaatggaaaactttaataatttctatatacttacatctaaagagctagggagaggaaaatttgctgtggttagacaatgtatatcaaaatctactggccaagaatatgctgcaaaatttctaaaaaagagaa

SEQ ID NO: 180271 - DNA, 567 bp, Homo sapiens
  Payload ID: 15513
  Gene Symbol: STK17B
  Gene Name: serine/threonine kinase 17b
  ENST ID: ENST00000449152
  CDS Start-End: 548-567
aggtcgcgccaggcagggcccccttcgcggcgggcccgcgcgggtcccttccacagcaaggccacgcggtccccctagcctctcccgagtcccagctgcggcgtgggcgcgttcccatcgggactcgtggacgcgtcctgctcccagctgcctttcgtctagagaaaggcaaccagatgtttgaggagggcttggtggacaaaggtgacattcatgctccactatatgcaaaactggccaaaggagaggaaatggaaaaatatcttggctctgacaattggttcagatgcagtaaataaaaggaaaatgaacttaagaaatgcttaatggatgcctaaagcagcttgtgatcactggaagatcaattcttttatcatccatactttagaggcagcaaaatcgaagctttcttcaccagtaaaagggaatgcgaagtaaatcacaacaaaattccatttcaccttcatcacactagaatagccaaacttaaaagtctgaattgggtaaaaataagtgactaaagaagcagacctgggaatcacctaacatgtcgaggaggagatttga

SEQ ID NO: 180272 - DNA, 562 bp, Homo sapiens
  Payload ID: 15513
  Gene Symbol: STK17B
  Gene Name: serine/threonine kinase 17b
  ENST ID: ENST00000606789
  CDS Start-End: 1-210
aaatttgctgtggttagacaatgtatatcaaaatctactggccaagaatatgctgcaaaatttctaaaaaagagaagaagaggacaggattgtcgagcagaaattttacacgagattgctgtgcttgaattggcaaagtcttgtccccgtgttattaatcttcatgaggtctatgaaaatacaagtgaaatcattttgatattggaatagtaagtatatactaaatagtacctattttagttggtatgaaaagatgattaaaatgtcaagaataagaatgataaaggtgtgacaagaacttgtaaagattcctgttaataaaatgtaaaagggacctaatttatattcagatattttcataagactaaatgtatagcctcgggcacatacacaaaaactaacagcacagaataagcaaatgacaaatacaacatttgaggaatgtggagaaatgaatatacattattttcttaatggctaattgattgaatttttctggaacacaatctgatgggcagatagaattgaagtaatttgtatattttcttcatctatttgaaaa

SEQ ID NO: 180273 - DNA, 1663 bp, Homo sapiens
  Payload ID: 15514
  Gene Symbol: STK19
  Gene Name: serine/threonine kinase 19
  Uniprot ID: P49842
  ENST ID: ENST00000375331
  CDS Start-End: 167-1261
ctgcctctttccttgcccttcacccaccctccctccaggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtgatattt

SEQ ID NO: 180274 - DNA, 1557 bp, Homo sapiens
  Payload ID: 15514
  Gene Symbol: STK19
  Gene Name: serine/threonine kinase 19
  Uniprot ID: P49842
  ENST ID: ENST00000375333
  CDS Start-End: 54-1160
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 180275 - DNA, 1557 bp, Homo sapiens
  Payload ID: 15514
  Gene Symbol: STK19
  Gene Name: serine/threonine kinase 19
  Uniprot ID: P49842
  ENST ID: ENST00000383327
  CDS Start-End: 54-1160
cttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtatgtgactgtgtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 180276 - DNA, 1620 bp, Homo sapiens
  Payload ID: 15514
  Gene Symbol: STK19
  Gene Name: serine/threonine kinase 19
  ENST ID: ENST00000383328
  CDS Start-End: 129-1223
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 180277 - DNA, 1620 bp, Homo sapiens
  Payload ID: 15514
  Gene Symbol: STK19
  Gene Name: serine/threonine kinase 19
  Uniprot ID: P49842
  ENST ID: ENST00000426802
  CDS Start-End: 129-1223
gtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 180278 - DNA, 1557 bp, Homo sapiens; identical to SEQ ID NO: 180274
  Payload ID: 15514
  Gene Symbol: STK19
  Gene Name: serine/threonine kinase 19
  Uniprot ID: P49842
  ENST ID: ENST00000438256
  CDS Start-End: 54-1160

SEQ ID NO: 180279 - DNA, 1620 bp, Homo sapiens; identical to SEQ ID NO: 180277
  Payload ID: 15514
  Gene Symbol: STK19
  Gene Name: serine/threonine kinase 19
  Uniprot ID: P49842
  ENST ID: ENST00000424104
  CDS Start-End: 129-1223

SEQ ID NO: 180280 - DNA, 1620 bp, Homo sapiens; identical to SEQ ID NO: 180277
  Payload ID: 15514
  Gene Symbol: STK19
  Gene Name: serine/threonine kinase 19
  Uniprot ID: P49842
  ENST ID: ENST00000425138
  CDS Start-End: 129-1223

SEQ ID NO: 180281 - DNA, 1557 bp, Homo sapiens; identical to SEQ ID NO: 180274
  Payload ID: 15514
  Gene Symbol: STK19
  Gene Name: serine/threonine kinase 19
  Uniprot ID: P49842
  ENST ID: ENST00000433397
  CDS Start-End: 54-1160

SEQ ID NO: 180282 - DNA, 1620 bp, Homo sapiens; identical to SEQ ID NO: 180277
  Payload ID: 15514
  Gene Symbol: STK19
  Gene Name: serine/threonine kinase 19
  Uniprot ID: P49842
  ENST ID: ENST00000444147
  CDS Start-End: 129-1223

SEQ ID NO: 180283 - DNA, 1557 bp, Homo sapiens; identical to SEQ ID NO: 180274
  Payload ID: 15514
  Gene Symbol: STK19
  Gene Name: serine/threonine kinase 19
  Uniprot ID: P49842
  ENST ID: ENST00000431383
  CDS Start-End: 54-1160

SEQ ID NO: 180284 - DNA, 1557 bp, Homo sapiens; identical to SEQ ID NO: 180274
  Payload ID: 15514
  Gene Symbol: STK19
  Gene Name: serine/threonine kinase 19
  Uniprot ID: P49842
  ENST ID: ENST00000452688
  CDS Start-End: 54-1160

SEQ ID NO: 180285 - DNA, 575 bp, Homo sapiens
  Payload ID: 15514
  Gene Symbol: STK19
  Gene Name: serine/threonine kinase 19
  ENST ID: ENST00000460018
  CDS Start-End: 238-575
aggctgaaggtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggagggacgcccggggagaccgtacgtcactgctctgcgccggaagaccctattttcaggttctcttccctccattcctaccccttccccggtaccataaaatcccgggatatgagctg

SEQ ID NO: 180286 - DNA, 1039 bp, Homo sapiens
  Payload ID: 15514
  Gene Symbol: STK19
  Gene Name: serine/threonine kinase 19
  ENST ID: ENST00000483801
  CDS Start-End: 1-211
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataa

SEQ ID NO: 180287 - DNA, 1101 bp, Homo sapiens
  Payload ID: 15514
  Gene Symbol: STK19
  Gene Name: serine/threonine kinase 19
  ENST ID: ENST00000520138
  CDS Start-End: 1-211
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggttgctcttgttctctccttctgtggttcatctgggggtccccctatcggtgggggtgcagctccaggatgtgccccgaggacaggtagtgaaaggatcagtgttcctgagaaacccatctcgtaataatgtcccctgctccccaaaggtggacttcacccttagctcagaaagagacttcgcactcctcagtctccaggtgcccttgaaagatgcgaagagctgtggcctccatcaactcctcagaggccctgaggtccagctggtggcccattcgccatggctaaaggactctctgtccag

SEQ ID NO: 180288 - DNA, 798 bp, Homo sapiens
  Payload ID: 15514
  Gene Symbol: STK19
  Gene Name: serine/threonine kinase 19
  ENST ID: ENST00000523972
  CDS Start-End: 1-211
ccccttccccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaag

SEQ ID NO: 180289 - DNA, 1804 bp, Homo sapiens
  Payload ID: 15514
  Gene Symbol: STK19
  Gene Name: serine/threonine kinase 19
  ENST ID: ENST00000549310
  CDS Start-End: 443-1408
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttagcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 180290 - DNA, 1804 bp, Homo sapiens; identical to SEQ ID NO: 180289
  Payload ID: 15514
  Gene Symbol: STK19
  Gene Name: serine/threonine kinase 19
  ENST ID: ENST00000549916
  CDS Start-End: 443-1408

SEQ ID NO: 180291 - DNA, 1804 bp, Homo sapiens; identical to SEQ ID NO: 180289
  Payload ID: 15514
  Gene Symbol: STK19
  Gene Name: serine/threonine kinase 19
  ENST ID: ENST00000550656
  CDS Start-End: 443-1408

SEQ ID NO: 180292 - DNA, 1804 bp, Homo sapiens
  Payload ID: 15514
  Gene Symbol: STK19
  Gene Name: serine/threonine kinase 19
  ENST ID: ENST00000547578
  CDS Start-End: 443-1408
gtctgacacaagcattagtgagatgctcccctcgaagaatagtcttgtttcttctaaggactgattctcaccccggctttggctctcctaattttagagggtcctccaaatgcagtgaggttaggaaggacgtctgcgctcagatcaagaatccagttacctcaaagctccccaacttccacctccgcagagctatgacgtcatggcaggcacgccagaggccgaaggatgcaaaagtggttttctgctttcgatgatgcaatcattcagcgacagtggcgggcaaacccctcccggggcgggggaggtgtgagcttcacgaaggaggttgacaccaacgtggccaccggcgcccctccacgccgccaacgagtccccgggcgtgcgtgcccttggagggagccaatccgcggccggcgtggggcccggcctggcggaggtgatgctggtatgtgcgtcgccaccgcccctcccagcactgacgggcctgagggacgacaagttgacgctcctttcgtcatcacctggtctaggagggacgcccggggagaccgtacgtcactgctctgcgccggaagaccctattttcaggttctcttccctccattcctaccccttccccggtaccataaaatcccgggatatgagctggaagaggcatcacctgatcccggagacctttggagttaagaggcggcggaagcgagggcctgtggagtcggatcctcttcggggtgagccagggtcggcgcgcgcggctgtctcagaactcatgcagctgttcccgcgaggcctgtttgaggacgcgctgccgcccatcgtgctgaggagccaggtgtacagccttgtgcctgacaggaccgtggccgaccggcagctgaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtg

SEQ ID NO: 180293 - DNA, 1804 bp, Homo sapiens; identical to SEQ ID NO: 180289
  Payload ID: 15514
  Gene Symbol: STK19
  Gene Name: serine/threonine kinase 19
  ENST ID: ENST00000551718
  CDS Start-End: 443-1408

SEQ ID NO: 180294 - DNA, 1101 bp, Homo sapiens; identical to SEQ ID NO: 180287
  Payload ID: 15514
  Gene Symbol: STK19
  Gene Name: serine/threonine kinase 19
  ENST ID: ENST00000519179
  CDS Start-End: 1-211

SEQ ID NO: 180295 - DNA, 1049 bp, Homo sapiens
  Payload ID: 15514
  Gene Symbol: STK19
  Gene Name: serine/threonine kinase 19
  ENST ID: ENST00000481181
  CDS Start-End: 1-204
cccggtaccataaaatcccgggatatgagctggaagaggcatcacctgatcccggagacctttggagttaagaggcggcggaagcgagggcctgtggagtcggatcctcttcggggtgagccagaaggagcttcaagagcagggggagatcagaatcgtccagctgggcttcgacttggatgcccatggaattatcttcactgaggactacaggaccagagtcctcaaggcctgtgatggccgaccgtatgctggggcagtgcagaaatttctagcttcagtacttccagcctgtggggaccttagtttccagcaggaccaaatgacacagacctttggcttcagggactcagaaatcacgcatctggtgaatgctggagtcctcaccgtccgagatgctgggagctggtggctagctgtgcctggagctgggagattcatcaagtactttgttaaagggcgccaggctgtccttggcatggtccggaaggcaaagtaccgggaactgctcctatcagagctcctgggccggcgggcgcctgtcgtggtgcggcttggcctcacctaccatgtgcacgacctcattggggcccagctagtggactgcatctctaccacttcaggaaccctcctccgcctgccagagacatgaagattctgctcatcattgctcagctcctcagagtgggccgggaggggactagaagagctgcatgatggtggctgagacagggtcaccttgggaaggcttgggagccaggatgagtgtcgggctctcgtgtgtgcaaaaggtcagatgtgactgctgctgtttgcctggtttctgacccagtggtggggtttgagcaatgcttctctgcccttccatggaaagtggaaccagaaatggtgccaaggctgtggctgttccctttcgtgtaaaatggtgctgttattactctgtcttgaaataggaaggtgggatttctggggaggctggtgaaggagggcagggttcttttctctacgtgtcatgttaaaattgccaaataaagtacctctgcctgtga

SEQ ID NO: 180296 - DNA, 2492 bp, Homo sapiens
  Payload ID: 15515
  Gene Symbol: STK24
  Gene Name: serine/threonine kinase 24
  Uniprot ID: Q9Y6E0
  ENST ID: ENST00000376547
  CDS Start-End: 147-1478
tttgggttagggagagtgctttcgtttgttttaaatgggagaaactggagcatgttgccaagggcagagagccagcagagaggggtgaatggaagaaggagcgagaagggggttactgacgaagccttatcctggaggagagaaggatggactccagagcccagctttggggactggccttgaataaaaggagggccactctacctcatcctggagggagcacgaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgctta

SEQ ID NO: 180297 - DNA, 3602 bp, Homo sapiens
  Payload ID: 15515
  Gene Symbol: STK24
  Gene Name: serine/threonine kinase 24
  ENST ID: ENST00000376554
  CDS Start-End: 1-630
gcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgag

SEQ ID NO: 180298 - DNA, 4578 bp, Homo sapiens
  Payload ID: 15515
  Gene Symbol: STK24
  Gene Name: serine/threonine kinase 24
  ENST ID: ENST00000397517
  CDS Start-End: 366-1604
gggacgcgctcggcgctcgcgggctcggcgggctgtgcgcgcccactccggctccagcggccagcgcgcgcgggcccaggccgcccggctccagcccagcagtagcggcagcagcggcggcggcggcagtgcgcgcgaggccctgcgcccccagcagctcctccctggcgccgtgcatggagacgcggcccgccacccgccgctgagcccccgccgcccggccgggacccgccagggctggggtggcctcgggctccggccggccccgccgcccgagggctgcgcgcggcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaagttagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgagta

SEQ ID NO: 180299 - DNA, 1590 bp, Homo sapiens
  Payload ID: 15515
  Gene Symbol: STK24
  Gene Name: serine/threonine kinase 24
  ENST ID: ENST00000444574
  CDS Start-End: 1-1108
caaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacc

SEQ ID NO: 180300 - DNA, 2172 bp, Homo sapiens
  Payload ID: 15515
  Gene Symbol: STK24
  Gene Name: serine/threonine kinase 24
  ENST ID: ENST00000418038
  CDS Start-End: 1-429
aagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagaggtaactacccagggcccctctgggctggggaaggagagacctgcacttgggctgggacttagttgatgagtttggtacttgattcttggcctgtctgttcctgttatcttgcaggcctcagggtagacagagttgaattagaggagactttgttctgaattctagaaatcaatgtgaatgaaggatctgaatctggaaactactggaaagcccacaggacttagtgcatttgtagcttttgccacataaatacagggtggtggtgaaatacctgtttcctcttaattatgcagcttaattattggccagagaatgatcgttcttagccagatgtgtgtaactatctatctggttttcggctttaaagtcaagtgtgagaaatgacagcagctttggtgtggtcaactcagcgggagcgggcgcaggtgtgttccctgtgttagctgtgtgtgtcatgtctggaagcctccttggtaggggttcatctgtgccagcctgtagggagcttttgtccctgcccagtggccccacctgttgaatgcactatgggtgaggactcagtggggtgacagttttgccctccctgccccctcccaacttgttgtaggagtatccatgggaaccaagcccctcctgactgccatctggcacaagtgcaggcgtttggaggcagtggatgtgtgctgggaagccgctctgtgtgacctgagggtgatttgtcactgggctgtcctccacacccccaggaggaccaggcgtgctgctgccttgacagttcatcttcaggtgtccaggctgacacctcccaaagctggctgagactctgtgatcatgagggggatttctgggtctttcctgagactgcgtcccacctgacagtacataaagaagttttgcacacgtgaggtcccttttgctatttggaagtgattgaaggggctgcctactgtcctgtgaagagcccctctacgtggggacagcaggagaaaaccacagttctgatacttcacgtttatgcttctgaactcgggtttcttagtaagacatttcaactttttaagttgctagaaaataaaaatgatctacttggctgccttcaattttgaggcaattgaaggacgatccctccctcctttgatactaaaaacaatataggaataaaggaaaatagaattaaaaagtcacccatcttttgcctgaacacaaactttttgatttctcaaacttagcatcacatacctcattctagaggcatttatttcccattagaaagagctttataataaaacaaatagaacaaaaccagaaacgggtaggattgttactgtcttgttgggcattttgctctctgcttttgtagtattacttttaaaaccaatactttccacactgtccagaattgcctgaaattgttatgaactgtttgtttatatacgtgacttgatttccccagggcagctccagggcacagagtgtgtggcttgtatgtgttgaactgatccacgtttcccattcccaggcccctatctctctgttcctcttcttttagttgttaaggcaagttgatctgtaccagtgctggccagtagaagtacagcgtgggccacacacagaattttatgttttctgctggatgtggtggctcatgcctgtaatcccaatgctttgggaggcccaggcaggaggatcgcttgaggccaagagtttgagaccagcctgggcaaaatagcaagaccctgtctctacc

SEQ ID NO: 180301 - DNA, 9361 bp, Homo sapiens
  Payload ID: 15515
  Gene Symbol: STK24
  Gene Name: serine/threonine kinase 24
  Uniprot ID: Q9Y6E0
  ENST ID: ENST00000539966
  CDS Start-End: 78-1373
gcccgcgggcctcgccgccccgcgcggatcgtcgcggcccggccgtcccgtcccaggaagtggccgtcctgagcgccatggctcactccccggtgcagtcgggcctgcccggcatgcagaacctaaaggcagacccagaagagctttttacaaaactagagaaaattgggaagggctcctttggagaggtgttcaaaggcattgacaatcggactcagaaagtggttgccataaagatcattgatctggaagaagctgaagatgagatagaggacattcaacaagaaatcacagtgctgagtcagtgtgacagtccatatgtaaccaaatattatggatcctatctgaaggatacaaaattatggataataatggaatatcttggtggaggctccgcactagatctattagaacctggcccattagatgaaacccagatcgctactatattaagagaaatactgaaaggactcgattatctccattcggagaagaaaatccacagagacattaaagcggccaacgtcctgctgtctgagcatggcgaggtgaagctggcggactttggcgtggctggccagctgacagacacccagatcaaaaggaacaccttcgtgggcaccccattctggatggcacccgaggtcatcaaacagtcggcctatgactcgaaggcagacatctggtccctgggcataacagctattgaacttgcaagaggggaaccacctcattccgagctgcaccccatgaaagttttattcctcattccaaagaacaacccaccgacgttggaaggaaactacagtaaacccctcaaggagtttgtggaggcctgtttgaataaggagccgagctttagacccactgctaaggagttattgaagcacaagtttatactacgcaatgcaaagaaaacttcctacttgaccgagctcatcgacaggtacaagagatggaaggccgagcagagccatgacgactcgagctccgaggattccgacgcggaaacagatggccaagcctcggggggcagtgattctggggactggatcttcacaatccgagaaaaagatcccaagaatctcgagaatggagctcttcagccatcggacttggacagaaataagatgaaagacatcccgaagaggcctttctctcagtgtttatctacaattatttctcctctgtttgcagagttgaaggagaagagccaggcgtgcggagggaacttggggtccattgaagagctgcgaggggccatctacctagcggaggaggcgtgccctggcatctccgacaccatggtggcccagctcgtgcagcggctccagagatactctctaagtggtggaggaacttcatcccactgaaattcctttggcatttggggttttgtttttccttttttccttcttcatcctcctccttttttaaaagtcaacgagagccttcgctgactccaccgaagaggtgcgccactgggagccaccccagcgccaggcgcccgtccagggacacacacagtcttcactgtgctgcagccagatgaagtctctcagatgggtggggagggtcagctccttccagcgatcattttattttattttattacttttgtttttaattttaaccatagtgcacatattccaggaaagtgtctttaaaaacaaaaacaaaccctgaaatgtatatttgggattatgataaggcaactaaagacatgaaacctcaggtatcctgctttaagttgataactccctctgggagctggagaatcgctctggtggatgggtgtacagatttgtatataatgtcatttttacggaaaccctttcggcgtgcataaggaatcactgtgtacaaactggccaagtgcttctgtagataacgtcagtggagtaaatattcgacaggccataacttgagtctattgccttgcctttattacatgtacattttgaattctgtgaccagtgatttgggttttattttgtatttgcagggtttgtcattaataattaatgcccctctcttacagaacactcctatttgtacctcaacaaatgcaaattttccccgtttgccctacgccccttttggtacacctagaggttgatttcctttttcatcgatggtactatttcttagtgttttaaattggaacatatcttgcctcatgaagctttaaattataattttcagtttctccccatgaagcgctctcgtctgacatttgtttggaatcgtgccactgctggtctgcgccagatgtaccgtcctttccaatacgattttctgttgcaccttgtagtggattctgcatatcatctttcccacctaaaaatgtctgaatgcttacacaaataaattttataacacgcttattttgcatactccttgaaatgtgactcttcagaggacagggcacctgctgtgtatgtgtggccgtgcgtgtgtactcgtggctgtgtgtgtgtgatgagacactttggaagactccagggagaagtccccaggcctggagctgccgagtgcccaggtcagcgccctggactgcttgcgcacttgctcaccgagatgatgcagttggaggttgctgatctgtgcgattgctgtagcggttgccggggaccttaagagttattttgcttctctggaaggggcctatgcttgctaggcaggcagccagtgtgtctgtttttcttggtttgctgtgggaccttgcttggcgagggggaaaatctctgggtttctggagtgggagggttcgtgcagcagctgttgactggtacatgaagcattcttttatgtttgttgaagctgatgattgacatctcccgtgggtgtgccagttcttgtggagttaagacaggatttttggaagcaaggaagttagtgggtgagcttggggatgtagctcagctatctgctggtctagtggcctctaagctatagggaggggacagagccctgagctacagatgcttgagtgggttattgtgtcggtttgctagtgcagtctggtttttaagctctaaaattgaggtattttattagaagtggatttgggttgaactcttaatttgtataagggatatattttggttggggaaatagaactgagttgctaattcttattgtactcattactccatacaagaatgttatgttgaataataaaattggagaagatttcattttgtgtttccagggagtattctgtgtggggaactgtttccttacgtgaggccggcggcataagtcaaagatgagttttgtccttgcgaatcacacagattgagtctgtgttccccagggtgtgccgttacctgatttttaagtgagccagggcggacagcagcttttctgatttacagagttcttcagatttacaaatggacaatgacatcacagtttttagcactgaagccagtctcatgctagtaacagtgggtgagccgctcgagggactgggttctaatgaatactggtatgaacggggagtctctgcagtcgccagacaaatcatactcagccccttcccccgtagagcaacaagtggttcttttagagttgactggcagcatttcctgtcgggggaggtggggtttgatggagttagaaagctcgcctctgtgtacattctctcctgggctgttactttctgtagacgcacaaaatcagccccaatgtttttaagggcatcttagccaaggaagctggcttttgtgtcgccacttccaggcctgcattaagagagagcccaggcaccagggctaccactggaacctgcctcagcgtcaactgctgctggtctgtagccaggcccagcctttgagacgggtttactgtcaccagtagcctctcagtgccagccctgagctgctcctggctcagctgcccagagcctgcagcctggggaggtactcagcctctgggagacgagggccgtggactgggtggctggtagctcctgcgtttttgagctgtgtcctggctggctgctgccaatgaggtggacaccagtgtggtttggggtgcactggccacttcttgctgggttctgattttcttggaagtgcatctgccttccttatccaatagttttatccctgcattgctcttgtgaagtggctggtttggttctgtatgtagcattttgtacctttcctctggcaaaacactgtcagtttataaacattttttatatttccctcctttaaaaacagcttgtgtatttctgctataaaatgtgtcagcaaaggcagagtgacctaatagggcatgttcttaagcacagggactgtatcatgcaggggccaataaagctcaagaaaacgagtatctgcatcattgtgtgtctcatgtgtagtgtgtctcaaactccactcagatggactgttacccacactagtattttcttgagggcacacaggaagcagaggtgctggtcacaggtcagaaccaccagtgtccagcaagtagtttggaatcaatcaatcattcagaaataaatagctgaggagactgccttgtccccaagtctccaggaatgagtgagtggtgacttctggagggagcctgatgctgctgtgtggcccggagctgtttgtttgctctgcccctgcctggaggtggggggagcatagggaacagtggggggcaggccctccctgtgtcactctgaacactggggctttagaaacccttgctggagtgtccccttcccccctccccccccacacagaaaatgaagactacagacaaagttggttgttttgccttaaaacatcaatatgctggattgtggcgtgaggtatttttattccctttgttagtactggaaaccgtctggtacatcttgtaaggcaaatgattaacacacggcaggctcttcgtccgtttgcaagttgctgtttgtttccagctacaccagtcagagctccacagagagggtgcgttcctggttctcaggtgggcaggtgctatggtgcggggcgctggaaagaatggggttgaattggccctcgcctccgcttgtttgagactctcgttagaaagggcttaggaaaaccaagggaatggcagccaccccatcaccatcgagaacaggcagacgtttcccgagtaggggccaaagccactggaaaccgtgttccctgtgcagtccgactgacactaccccatgcctggggggaatgagtataaaaagggaaatgtttttgaagacaggcacgatatatactactagagaatgcgcagtttcaaaccacagttgcaggaggatataggaataacgacaggtgccggggactacgtaccatgatttcatagtgctctgcagccagcaggctcactaaacgctcatcacggaacataccacaaatggtgctgatcaatgacacacgggttttcatgcttgtgacacagacagacagcaaaacaccacggcttattatcttcccattgtgtacaccactcacaggacggtgacagtccaggtattgcactggatctcggctttgcttaacagaaaacaaccctgctacggttggaaagagttaccacttaaaacgatttggtcaacttgcaccaagaagtaggttgggaacaggtgttttcaggtgagcgtgaaaccccgcagtggaacgctgtgtgctgcaaattgcttattaatcagagaagtgagtcctactaacttcctattattacaaaagtagaaagactgaaaaaaaaaatgaaatctgaaaatgatctcatttgcttaaggctgcactgagtgtattgcaaacaaacaaacaaacaccgggaagtccacttcgtaaaatgcagcagccaataggtgaaaataataaaagaaagaactttttttaggaagaaaaacacttgccctgtcttgtgttgaacggatgtgtgtgtactgtttttcaggggcagggtggagggaagatgtcatttggcactctcgtaatgacaatgttttaatactggcactagctaaagaacagcgcccccagcggatgccaggactggaggtgggagcgctgttcattcagacgctgagaggtcggggttaaaaaacgcggctgtggagacaggagagctgctgggaagccatgtttttgattttcagacaggtgttaattttaccaggcttcattaatacagaagaaaggaaacgtcttccaggaaagcagccactgcggaaacgagtgtgtccggccatcaatacacaagagactctttgtgactcaacacgtggggtcgcgaggcagagctggtggcactgcggatcacttccatccacctgcaacacgggaacgccagttagtcaaccttttgtttggacggactcctgacactttggtgggcatcgcttacagaaacacaaggtgaagtcaggccgcctggttggtaatctgccacttcagcagaagagcaagggaacagccagcacccaggcgttcctgaggtacagtggagacccactggcctgggcactcactcagtgtggagctggaagtaccttgctgcagtgacactgcccgctccattggagcagttaggagcgaggtggcctctggttgctggggagaacgctacctcctattttcatggacatggcagagaatggcgggacgtgtcccatcctgcttagtggaagctctcccttccttttttctttttcttttttttttgagacagggtctggctctgtcactcatactggagttcagtggtgcagttatcgcccactgtagctacctcctgggctcaatcgatcctccagccttggcctcccaggagatgggactacaggcttgcaccaccacgcccaaatctccctttttatatatttgtgtatttgctctctaccggtgcttctcaaatgggtgcaatgctgtcccatttggtaaagtctggagacatttttagatgtcccaactgaggggttgctgcgggcatctagtgggtggccagggatgccgctgaacatcctgcacaatgcaggacggactccccaaattacctggccttgtcccaggcctttcaggatctggactgcaaggctggaccctttgtcacaataatagcaaaatcccaactttgatcaacccagctctcaacccagctctcgagctcagtccaggatcagatttgagaatggctctcctctaggttcctttttcaggtgatgttgtttaggaggtgctcagcatattgctgaggacccctccccttctgcctcccggggcgaggagggctcagcagggcaaactgcacaagtagtcggcttggggatgcaatttgcagaggcccaggatctctattcaaaatatgaattgcaggaacagtcttaggcctgactgttgcatttctttcttggctaaatgaagtctgcagtccctgccattacaccatgtaggcagtctcactggggcttagcttcatcatcccggacacgttatgtcagagatctccaagcaagatgtctagggcctcagccaacaccgtgcagggtaagggcgcagggaagttgggaccccactttctgccatgagaacagaatcgcctgctggtgtcgggcagtgggaccccaggtctaaacgcttagttggcagggaagggtggggccatctcactcgctgacttgggagaaatcctgatgtttggaagagggggtcctcttctgcagggccctgtgcgtgggaagggggtgtctacctttcgaacgtgtactcgctttccgccctgaagtagtagacgtgggacttgaagtgcagcttgaacacgtagtctttctggatgttctcggactcagaggggatggtgagcgagtagccgagcagaggcaggctggcaaggggatgattgtcctggaaaggggaaacaaagcaaagtggcttttcggggtcagcttctgctgctgggcctggctgctgccccgcatcagacagggacttgggagcccaggcagctccctcctcgggcgtgggcctggaagggaccatggcagccagtgtttgcctgtacgtgatggcccgggtggcaagtcccgccaggactgagctgtagataaagccaacccccgtcccttgtccaggcagaagacaggtggcccttcctagggcagaagttgtccttcagtggatgataatgtcagtcttccctagagttgagggcctcgggtggacagggccccccgccagcatccctgtcatccccgtgacacctggagcccaagaggcctgagtcattccagaggagggcggccccctcacctcatgctgccacccccaaggtcccagggccacctgccctgtgcgagacacttacctggtgtgatttgtagaagaacaggcagaagtttgtgaacaccacccacagcttctgccacccgttgctgtttttgaatttcctcagcaggtttccagacaactgattctgaaaggcaaggaggcctgtgagaagcacagcgggcacctgccccaggagggcacagagagcagctctccctgcaccagggccctgggctggggcatgtccgtgactgaaggatgtgggccccacccccgctcccccgtgtgtggggagacttggcaggtcctgggaccctgatctcatcacttccccttgtcacttgctgtggggcatcttggggtccctgtgtccccccaaaagacacgttgaggtcctgactaccagtaccttagaacacaggcttatttggaaataggctcgttgcagggtaactagtgaagacgagatcacactggggtagggtgggccctaaatccaacgggagtggtgtcctgaggagaagagccaccttgaggggagaggggtgtgccctgtgacaccgaggcagaaatgggggcgcaggaccccatgcattgccagcaggcggaagctgaaggagggaaagatccatcccaacaagctcagagcagcactcgttttgaggggccaggcaccctacccaggaagtggggcctggggtgcatgtgagtggctcccacatgccctctagtggcccaggaggcagttgcagccctgcccacctccaggctcagggccggcccagcccctggagcattgttaggatgcgctgcagcccagctagggggcagggacaggcacctgtgtccatgctacctccaaacaactctgagcaggcctgacgcactggtggctcatttcgtccctttgccaaagtgacatcaccagcagagactcaaagcagttgcaccaccttgtaaaggcacttaatgccactgaattgttcccgtaaaaatcgttaagttggccaatattgtggtatagctattttaccacaataaaaaatacagacctccga

SEQ ID NO: 180302 - DNA, 4619 bp, Homo sapiens
  Payload ID: 15516
  Gene Symbol: STK25
  Gene Name: serine/threonine kinase 25
  Uniprot ID: O00506
  ENST ID: ENST00000316586
  CDS Start-End: 351-1631
gtccaacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacatgcaggtgtgtgtggtggggcccgggccatgcggggctgcagcgtccctggtcccgagtcctcatcacagcacgcagagacggcagcccagccccccttcgaaacttccctgtgacggattcctgggctctgcttggcccaccggaagaacagagcaggcagaggagaatgcaggtggggagatgctgtttgtttatttttaatcaaatgtgtgtgaacaaagcagtcgcccatctacttcccgttggaaggaatgctgggcagtaataaattagacggccccaccctcccagggcacagggggactttggtttctgcttctctagaggtacatggggaacaagcgtggcttctgccagacttgtttagctgtgacctgcagggcaggcccctggggctgccacttggttcaccagatggaaggtcagcatggctgtgccacgcttgtctgagagggtcctggcagtgggtacgcagggtgtatggcagggcctcttttccagtgcttgctctaggccagtcctcggcagggaccctgctctggggagagaggcagggtgtgcccaggctttggtccgatgccgagagcactgctcaggccttgtctgcgtctttgagccaggggcctgggagctgtggcttgagcggctccgcgctcaagactcgcacatttttcccagggccccagatagctgctggcatgcactaggtcctgggtggggggatgaagcccctcccagatgttacatgaggcccacccacactgctggtgccagtggggatccagtgagaccacagccacttcccatctgttgagaagcctcaggacagaggtcacctctgtgtcctgctgttctttgtagttgtgtccaaacctgggcaggttgagcgtcattcctccttccccctgaccatcccctccagccctgaggagggttgggggccatcctgcacgatgcttggggccctcccggctgagctgctggccccctggatcacctccatccacctggaggagagggcggccatcagaccagtgagccatcttgtgctcagacactgtcccaagaacaacccaggatatgggacaagcaggacaaaagaagggttaaaaacctggggccgggtgcggtggctcatgcctataatcccagcactttgggaggctgaggcagatggatcacttgaggtcaggagttcgagaccagcctggccaacatggtgaaaccctgtctctactaaaaatacaaaaattagccaggcggcgtggcgtgcatgcctgtaatctcagttactcaggaggctgaggcagaagaatcgcttgaaccctggaggtgcaggttatagtgagccaagattgtatcactgcactccagcctgagtgacagagggagacgccatctccaaaaaaaaaaaaaacaaagcattgctgttttttggaaatgctggaagcattgctcagcccttcctttccagggcccagaaaacttgcctccaccaccatgagtagaaatgggagctgagcggacatcgaaatgggcagctgaccagggctgcctcctgcaaaattacctttcaaatgtgtacttgctctcagcccggaagaagtagacgtgggatttgaactggagcttgaaaacatagtctttgtgtatgccatcggcctccctggggatgctcacgctgtagcccagcagcgggaggctggccagtgggtagtcatcctgcaagacagcatagggacacgggttccaggggctgggttgccacagggaatgcccattcctctgctacctgcacaacggtggcacgtacaaatgcccacgggccaagggagccagtttccctgttcacacagcacagggtgtgtgggcaaagcatgggagggcagaaccaaaatacaaaagggacacaggtgagcagggttaagtgtctgtctgctagcatcacctgcattgggctccagtgaaactccagtacctgatgagttttgtagaagaacaaacagaagttggtaaagacgacccagagcttctgccagccatgactgtttttgaactttcttagcagatatcctgaaagctggttctgtcaataaaggaaaaatgcaggtgcattaaccagcacccaggaccccttgtgggagtgggtttgctccccaagactaagcctctgcatgctttctccagctgaggccttggttttacctctggactgctatgaacagcagctttatcagtacttaagtccaacagaagcatgttaaaaacctagagtgacattccaggcaccaagtaaagtgagttccctttccctgtgcacaataaagtcagtgttcagtaa

SEQ ID NO: 180303 - DNA, 2210 bp, Homo sapiens
  Payload ID: 15516
  Gene Symbol: STK25
  Gene Name: serine/threonine kinase 25
  Uniprot ID: O00506
  ENST ID: ENST00000403346
  CDS Start-End: 285-1565
aacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcggtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagaca

SEQ ID NO: 180304 - DNA, 1904 bp, Homo sapiens
  Payload ID: 15516
  Gene Symbol: STK25
  Gene Name: serine/threonine kinase 25
  Uniprot ID: O00506
  ENST ID: ENST00000405883
  CDS Start-End: 215-1264
gttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgaggcggcgcggccatggctcacctccggggatttgccaaccagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttgg

SEQ ID NO: 180305 - DNA, 1643 bp, Homo sapiens
  Payload ID: 15516
  Gene Symbol: STK25
  Gene Name: serine/threonine kinase 25
  Uniprot ID: O00506
  ENST ID: ENST00000405585
  CDS Start-End: 181-1230
gctttctccggtcgctgccgccaccaccgttgcttcgcgggctgggaggcccggggtccccgggcgaacagaggctgcggtggactgacgccgcaggggcgagctagccggctccgcgcctctccgcgggatccagacgcctcctggggctgctggcggagggtctgaggcggcgcggccatggctcacctccggggatttgccaaccagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagccccc

SEQ ID NO: 180306 - DNA, 2251 bp, Homo sapiens
  Payload ID: 15516
  Gene Symbol: STK25
  Gene Name: serine/threonine kinase 25
  Uniprot ID: O00506
  ENST ID: ENST00000401869
  CDS Start-End: 328-1608
gggacaccggggcgggggcaccgggaggaagctgccttggaagaggtgggggcggcgacgggaggggcggcgagcccccgggagcctgggcgttaggcccgggcgtggcggggccccggcggcctggggggtctcctgggcccccccccacccatggagcccgccgccccggaggtcggtctcagatgactgaactgggcaccgagcgcccctggtgtccctcgcagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggaga

SEQ ID NO: 180307 - DNA, 801 bp, Homo sapiens
  Payload ID: 15516
  Gene Symbol: STK25
  Gene Name: serine/threonine kinase 25
  ENST ID: ENST00000413760
  CDS Start-End: 357-801
acggcttccagcagcagtcactgtcctgggcgcgtcccgcgctctagcccaggtgggtcccacaacggtgtgaccaaggacgtcctatgaccaccccttgacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagccct

SEQ ID NO: 180308 - DNA, 882 bp, Homo sapiens
  Payload ID: 15516
  Gene Symbol: STK25
  Gene Name: serine/threonine kinase 25
  ENST ID: ENST00000450497
  CDS Start-End: 352-882
tcagtgcgacagcccctacatcacccgctactttggctcctacctaaagccctgtaggactggatcagcagcctggtttttgatggggtcttggtgaagtggagtcagccactgctgtgtgtactcaacctgtcctctgagcatctgtagcagtagtgtggcaggaggggaagatgggcaaggccgagagagccctttcctgttcagggttcttggcagggatgggaccggtggggcctgggccctggctgactccggcctgtgactcccaccctggagcatgcccttcctcttgctgccaaatgctgatgggtttgtctccggtcccagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcaca

SEQ ID NO: 180309 - DNA, 570 bp, Homo sapiens
  Payload ID: 15516
  Gene Symbol: STK25
  Gene Name: serine/threonine kinase 25
  ENST ID: ENST00000435225
  CDS Start-End: 425-570
tagagatggggtttcaccatgctggccaggctggtctcgaactcctgacctcaagtgatccacctgcctcggcctcccaaagtgctagaattacaggcgtgagccaccacgcccggccaagtttagtttttgaacaaaaagggagaaaggaagaaaccagagaagaattgagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagg

SEQ ID NO: 180310 - DNA, 923 bp, Homo sapiens
  Payload ID: 15516
  Gene Symbol: STK25
  Gene Name: serine/threonine kinase 25
  ENST ID: ENST00000442307
  CDS Start-End: 435-923
gggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattc

SEQ ID NO: 180311 - DNA, 935 bp, Homo sapiens
  Payload ID: 15516
  Gene Symbol: STK25
  Gene Name: serine/threonine kinase 25
  ENST ID: ENST00000440109
  CDS Start-End: 761-935
gtaaagaagcaggggtgatgagagatgcggacccaggaggggttcaaggggctgtcctggacgcatgacagggaagcatagcttcttaaaggactcggcagtgcaccatgagaagacacgcaccagggagcagagagaaacgccagaaccctctcgaagaaggagggatgtgaggaggtcaggatagtcacctgtgctgagccatcatggagagtgagggcctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaaggtcctgctgggggtggatgtggctcttgta

SEQ ID NO: 180312 - DNA, 773 bp, Homo sapiens
  Payload ID: 15516
  Gene Symbol: STK25
  Gene Name: serine/threonine kinase 25
  ENST ID: ENST00000423004
  CDS Start-End: 1-743
cgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacatcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggt

SEQ ID NO: 180313 - DNA, 395 bp, Homo sapiens
  Payload ID: 15516
  Gene Symbol: STK25
  Gene Name: serine/threonine kinase 25
  ENST ID: ENST00000420551
  CDS Start-End: 129-395
gggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagagttccagtcacctcgaggtctggcactcaaaaagggatgtgcagcggcatgtttcaagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgac

SEQ ID NO: 180314 - DNA, 580 bp, Homo sapiens
  Payload ID: 15516
  Gene Symbol: STK25
  Gene Name: serine/threonine kinase 25
  ENST ID: ENST00000429279
  CDS Start-End: 344-580
gtcgcctccgggctttctccggtcgctgccgccaccaccgttgcttcgcgggctgggaggcccggggtccccgggcgaacagaggctgcggcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaac

SEQ ID NO: 180315 - DNA, 779 bp, Homo sapiens
  Payload ID: 15516
  Gene Symbol: STK25
  Gene Name: serine/threonine kinase 25
  ENST ID: ENST00000439101
  CDS Start-End: 722-779
gctgccttggaagaggtgggggcggcgacgggaggggcggcgagcccccgggagcctgggcgttaggcccgggcgtggcggggccccggcggcctggggggtctcctgggcccccccccacccatggagcccgccgccccggaggtcggtctcagatgactgaactgggcaccgagcgcccctggtgtccctcgcagtggactgacgccgcaggggcgagctagccggctccgcgcctctccgcgggatccagacgcctcctggggctgctggcggagggtctgaggcggcgcggccatggctcacctccggggatttgccaaccaggtcccttcctccccagcagggcagcctctgcctgtcccccgcctcttgtgaccggcgctgtctgccctctgtccccgccctggccccacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagcatgcccttcctcttgctgccaaatgctgatgggtttgtctccggtcccagagcaccaagctatggatcatcatggagtacctgggcggcggctcagcactggacttgcttaaaccaggtcccctggagg

SEQ ID NO: 180316 - DNA, 600 bp, Homo sapiens
  Payload ID: 15516
  Gene Symbol: STK25
  Gene Name: serine/threonine kinase 25
  ENST ID: ENST00000436402
  CDS Start-End: 146-600
gggacaccggggcgggggcaccgggaggaagctgccttggaagagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcaggg

SEQ ID NO: 180317 - DNA, 575 bp, Homo sapiens
  Payload ID: 15516
  Gene Symbol: STK25
  Gene Name: serine/threonine kinase 25
  ENST ID: ENST00000426941
  CDS Start-End: 230-575
gctgccgccaccaccgttgcttcgcgggctgggaggcccggggtccccgggcgaacagaggctgcgggtgggagccttcgcgggcgctgcagagcgggccgggggaggccgggatggagccccgcggagtggactgacgccgcaggggcgagctagccggctccgcgcctctccgcgggatccagacgcctcctggggctgctggcggagggtctgaggcggcgcggccatggctcacctccggggatttgccaaccagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaaggtgcctgttgtggggaggcggggaccctgctggtgctgtgcccggctctcttccatgtcagagggactgagtgacatgccagagg

SEQ ID NO: 180318 - DNA, 781 bp, Homo sapiens
  Payload ID: 15516
  Gene Symbol: STK25
  Gene Name: serine/threonine kinase 25
  ENST ID: ENST00000424537
  CDS Start-End: 299-781
agctgccttggaagaggtgggggcggcgacgggaggggcggcgagcccccgggagcctgggcgttaggcccgggcgtggcggggccccggcggcctggggggtctcctgggcccccccccacccatggagcccgccgccccggaggtcggtctcagatgactgaactgggcaccgagcgcccctggtgtccctcgcagtggactgacgccgcaggggcgagctagccggctccgcgcctctccgcgggatccagacgcctcctggggctgctggcggagggtctgaggcggcgcggccatggctcacctccggggatttgccaaccagcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattc

SEQ ID NO: 180319 - DNA, 2556 bp, Homo sapiens
  Payload ID: 15516
  Gene Symbol: STK25
  Gene Name: serine/threonine kinase 25
  Uniprot ID: O00506
  ENST ID: ENST00000543554
  CDS Start-End: 603-1601
gaaggagggatgtgaggaggtcaggatagtcacctgtgctgagccatcatggagagtgagggcctgtaagggtggacacagtatgcaggagggacaaatcttcctcaccggacaggtggggatccctgcggtgcactaggggaatgcacacagggggcactatgacctggcggcccacggggcacggggacgcaccaggtagccttgggatctgcaagtccctcccggaccctggggagtgccatgacggcttccagcagcagtcactgtcctgggcgcgtcccgcgctctagcccaggtgggtcccacaacggtgtgaccaaggacgtcctatgaccaccccttgacagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacatgcaggtgtgtgtggtggggcccgggccatgcggggctgcagcgtccctggtcccgagtcctcatcacagcacgcagagacggcagcccagccccccttcgaaacttccctgtgacggattcctgggctctgcttggcccaccggaagaacagagcaggcagaggagaatgcaggtggggagatgctgtttgtttatttttaatcaaatgtgtgtgaacaaagcagtcgcccatctacttcccgttggaaggaatgctgggcagtaataaattagacggccccaccctcccagggcacagggggactttg

SEQ ID NO: 180320 - DNA, 2459 bp, Homo sapiens
  Payload ID: 15516
  Gene Symbol: STK25
  Gene Name: serine/threonine kinase 25
  Uniprot ID: O00506
  ENST ID: ENST00000535007
  CDS Start-End: 506-1504
gtagtccaacgccagcaggcttccgggcccggagtgggcggtgggactcggggtcccagagagccgtgcgcgggccgcgacgccgagcaccgccctcgccgtcgcctccgggctttctccggtcgctgccgccaccaccgttgcttcgcgggctgggaggcccggggtccccgggcgaacagaggctgcgggtgggagccttcgcgggcgctgcagagcgggccgggggaggccgggatggagccccgcggagcactctcgagtggaccctgaggagctcttcaccaagctcgaccgcattggcaagggctcgtttggggaggtctacaagggcatcgataaccacacaaaggaggtggtggccatcaagatcatcgacctggaggaggccgaggatgagatcgaggacatccagcaggagatcactgtcctcagtcagtgcgacagcccctacatcacccgctactttggctcctacctaaagagcaccaagctatggatcatcatggagtacctgggcggcggctcagcactggacttgcttaaaccaggtcccctggaggagacatacattgccacgatcctgcgggagattctgaagggcctggattatctgcactccgaacgcaagatccaccgagacatcaaagctgccaacgtgctactctcggagcagggtgacgtgaagctggcggactttggggtagcagggcagctcacagacacgcagattaagaggaacacattcgtgggcacccccttctggatggcacctgaggtcatcaagcagtcggcctacgacttcaaggctgacatctggtccctggggatcacagccatcgagctggccaagggggagcctccaaactctgacctccaccccatgcgcgtcctgttcctgattcccaagaacagcccacccacactggagggccagcacagcaagcccttcaaggagttcgtggaggcctgcctcaacaaagacccccgattccggcccacggccaaggagctcctgaagcacaagttcatcacacgctacaccaagaagacctccttcctcacggagctcatcgaccgctataagcgctggaagtcagaggggcatggcgaggagtccagctctgaggactctgacattgatggcgaggcggaggacggggagcagggccccatctggacgttcccccctaccatccggccgagtccacacagcaagcttcacaaggggacggccctgcacagttcacagaagcctgcggagcccgtcaagaggcagccgaggtcccagtgcctgtccacgctggtccggcccgtcttcggagagctcaaagagaagcacaagcagagcggcgggagcgtgggtgcgctggaggagctggagaacgccttcagcctggccgaggagtcctgccccggcatctcagacaagctgatggtgcacctggtggagcgagtgcagaggttttcacacaacagaaaccacctgacatccacccgctgaagcgcactgctgttcagataggggacggaaggtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccacccctgcagtgtgctgttgtgcacgtcagggacgctgttctctatgcccactgccctcctccctctcctggcccagcagtattgctcacgggggctccagccgccggcgtggccctcatgagctacgcctgggtcttctgcagactcatgcagccctatggccgctcagaccaaggcgcagagcaactatcagggcagctctgcctcctcctcccatgaggtggggagaggcaacagggcagcccccagaggagtgtcctggccgctgtcctcccggggcccatgatggccatagatttgccttgtggtgttggatcaggtactgtgtctgctcataagtacttgtgtcatccagaatgttttgttttttaagaaaattgaattacttgtttcctgaaatattctgaggttaatatgttagttttcatagaacattgagaggcccctgccactttcaataaagacctgacttggagacatgcaggtgtgtgtggtggggcccgggccatgcggggctgcagcgtccctggtcccgagtcctcatcacagcacgcagagacggcagcccagccccccttcgaaacttccctgtgacggattcctgggctctgcttggcccaccggaagaacagagcaggcagaggagaatgcaggtggggagatgctgtttgtttatttttaatcaaatgtgtgtgaacaaagcagtcgcccatctacttcccgttggaaggaatgctgggcagtaataaattagacggccccaccctcccagggcacagggggactttg

SEQ ID NO: 180321 - DNA, 2826 bp, Homo sapiens
  Payload ID: 15517
  Gene Symbol: STK3
  Gene Name: serine/threonine kinase 3
  Uniprot ID: Q13188
  ENST ID: ENST00000419617
  CDS Start-End: 142-1617
ccgcggagttacgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccagca

SEQ ID NO: 180322 - DNA, 817 bp, Homo sapiens
  Payload ID: 15517
  Gene Symbol: STK3
  Gene Name: serine/threonine kinase 3
  ENST ID: ENST00000518165
  CDS Start-End: 132-817
acgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacagctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccac

SEQ ID NO: 180323 - DNA, 2065 bp, Homo sapiens
  Payload ID: 15517
  Gene Symbol: STK3
  Gene Name: serine/threonine kinase 3
  ENST ID: ENST00000424861
  CDS Start-End: 127-633
aaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacaggattcttaacagataccactgaaggaagtgctagctgtgatttgagaatggatctaacgcttttccatcttggagctgaattcttacattaccttcttctatatgaagcagatcctctctcatgtgttttctccctcttggtgttttcagtataaatctgaccattttgaaatagttgggtatggacctatccagcctcatgaaaagtcttacagatatgagaaagaattaagcatctgttttcaataaaatgctcataaagccacccattaatgtactcagggtgaaaggaatcaaaaaaattattggccagttaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgaggtaatgccttgattggttgtgtcacctgtgcagtagttgaaaatggatatgagtacacaatttcaggacctccctgcttccttgtagatcatttggccgtatgctatttttatgattcccacaaatccaccaccaacattcagaaagccagaactttggtccgatgatttcaccgattttgttaaaaagtgtttggtgaagaatcctgagcagagagctactgcaacacaacttttacaggtcagtgcttgtgcctcgaagggaaggatattttcttcatacctttcagctttctgacattggccagaattgctgtgtgtttcataactgatttctaaagatgtaaacctcccctcccctcctgtttgctcccttcttttctttcctcccctctcgtcccctcatttcccccagagtcattttaaaacaaaatttccaaagcattctcctttcagaaaggaatctttgtcttcatagttactatttctcatgttttttttttcttctgttccttgactcagcatttatcctttgactttttgctccaccataaaatatgtaagtacaagatccctggactccttgaagagattatcacgttgtaaatatcagttacaggattatctaaatgaagagcttcagagtttcaattttttttgatagaataattgtaagtagactttgtatccagaatgtcagtagattttaaaatctaccttaaaatttaatgcaaatagaaataatttaatatttataataggtgtttgtgaatcttaatttccccaacagaatagtcttagaactttcagctaataataagtatgtctcacattaacaaaacttgatatttgctaaatgatttctattgttaagtgacaaaaggatgaaaaacatggttcttgtaaaaagggacttccctgtctctaaaggaaccattgggtt

SEQ ID NO: 180324 - DNA, 531 bp, Homo sapiens
  Payload ID: 15517
  Gene Symbol: STK3
  Gene Name: serine/threonine kinase 3
  ENST ID: ENST00000519420
  CDS Start-End: 30-32
agagctcagtcctgagcctcagctgcgggatgcctgcggtcctctctctccaactgcctcattcctcctgcagcttttctcagtttgggagatttggagggagctttctcttccttcagactccccaagcctcccactcacggggtggtgacctgaagagcgttcctacgcttcgcacttccttttcatcaaaggggaggcaactccccagcagcgggcttcacacctttcccgcccttaagtatgtgtacgttgggtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaaggccattcaatgtcccttcttcaggaatttggaaaaaggatggagagatctctctgagctagactcttcagtggaggaaatg

SEQ ID NO: 180325 - DNA, 574 bp, Homo sapiens
  Payload ID: 15517
  Gene Symbol: STK3
  Gene Name: serine/threonine kinase 3
  ENST ID: ENST00000521649
  CDS Start-End: 107-355
gagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacaggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagc

SEQ ID NO: 180326 - DNA, 3107 bp, Homo sapiens
  Payload ID: 15517
  Gene Symbol: STK3
  Gene Name: serine/threonine kinase 3
  Uniprot ID: Q13188
  ENST ID: ENST00000523601
  CDS Start-End: 401-1960
gtgcagaaccgtttggttttcccgaggggtaggcagaatttccaaccccacgagctgctccctctttccgcaaacctcctaaccccggggtttttccataaatgtgtttacttcgtccacgccagcctgcgaagttccaaaatggagtctgggccacgccggcgttctgggcacgactacggtctcttgaaaagatttggaattgaccatgtagataatctctgagagcagttcttaaagtgtaatccagaaccggtggaacttgctagaaacgcatattcttcggaccccctccaaatctgctgaatctgagattgtggaggccattcaatgtcccttcttcaggaatttggaaaaaggatggagagatctctctgagctagactcttcagtggaggaaatgttacaactcatggacagtggcattaccatctgccttaggaacggagcagcctctgtcttcaagaaaaaagaatggagcacacaaggagaagaaaacaagcaagacagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacattaatagaagatgaaattgcaaccattcttaaatctacattgaaaggactagaatatttgcactttatgagaaaaatacacagagatataaaagctggaaatattctcctcaatacagaaggacatgcaaaattggcagattttggagtggctggtcagttaacagatacaatggcaaaacgcaatactgtaataggaactccattttggatggctcctgaggtgattcaagaaataggctataactgtgtggccgacatctggtcccttggcattacttctatagaaatggctgaaggaaaacctccttatgctgatatacatccaatgagggctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttt

SEQ ID NO: 180327 - DNA, 2485 bp, Homo sapiens
  Payload ID: 15517
  Gene Symbol: STK3
  Gene Name: serine/threonine kinase 3
  ENST ID: ENST00000617590
  CDS Start-End: 132-1274
acgggaaagttggtccgagttcccagagtttccctctgtggtgccctaggctcggccggccggtgccccggctcctttcctcctttcggccttcgccgtccaccaggtccctctctctgtccccggccgccatggagcagccgccggcgcctaagagtaaactaaaaaagctgagtgaagacagtttgactaagcagcctgaagaagtttttgatgtattagagaagcttggagaagggtcttatggaagtgtatttaaagcaatacacaaggaatccggtcaagttgtcgcaattaaacaagtacctgttgaatcagatcttcaggaaataatcaaagaaatttccataatgcagcaatgtgacagcccatatgttgtaaagtactatggcagttattttaagaatacagacctctggattgttatggagtactgtggcgctggctctgtctcagacataattagattacgaaacaagacagctatttttatgattcccacaaatccaccaccaacattcagaaagccagaactttggtccgatgatttcaccgattttgttaaaaagtgtttggtgaagaatcctgagcagagagctactgcaacacaacttttacagcatccttttatcaagaatgccaaacctgtatcaatattaagagacctgatcacagaagctatggagatcaaagctaaaagacatgaggaacagcaacgagaattggaagaggaagaagaaaattcggatgaagatgagctggattcccacaccatggtgaagactagtgtggagagtgtgggcaccatgcgggccacaagcacgatgagtgaaggggcccagaccatgattgaacataatagcacgatgttggaatccgacttggggaccatggtgataaacagtgaggatgaggaagaagaagatggaactatgaaaagaaatgcaacctcaccacaagtacaaagaccatctttcatggactactttgataagcaagacttcaagaataagagtcacgaaaactgtaatcagaacatgcatgaacccttccctatgtccaaaaacgtttttcctgataactggaaagttcctcaagatggagactttgactttttgaaaaatctaagtttagaagaactacagatgcggttaaaagcactggaccccatgatggaacgggagatagaagaacttcgtcagagatacactgcgaaaagacagcccattctggatgcgatggatgcaaagaaaagaaggcagcaaaacttttgagtctaatttcctctctgtttttaactattctggagaccaagaaaccactaggaattgaaggaatatttggatatttttaatcctaagattttgccctacaattaggcagaggtcaaaaagtgacaatggtacatgcccaggtaaattcccaaaaggcagaattgacagttgtatctgctgtgcattcactctaagatgaggagaacaaaagaagtgtattctcttgttctgtcagctgcataccagtaataaaactgttatgaaatggattttcaaggtctctaaaccttgaaaatccaaagctattgttgcattgtacagcactgaagggctttatgttacaatattctttattcctatctagtatactaggctatttattgtatccccttaggtaaacttatttatttatgctattttgctttgtttcattttttaaggacaagatcaggatagctttggtgaaggtagggtcatattaatatgatgataatgtgcaaccaatttatactttctgcagggagctatggggtacattccttgatttccaggatagtttttcaaataggaaagcaataatggcagtagttctcaaatgggctaggccttttttatattgaagcaataattccatttttaccctttgaaattttgtttttttgatttttgatgtttggtacaaatagaactatatatatttaggtaaaatagatctatcgtgtttaaaaccaaagaaatcaatggaacccttgcacaaaaaagtgtgataaatatttttaaataaaaacttaatacaaatgtaatttgttaatattgtttcatgttttatgtgtagatctaatagctgaactgattcaaactgtaataagctcatcaatttcatttctatgaaaatgtgctctgttgtcacaggatgtttctgttgattttattcatttcctgggaattggtaaacatcatgttcctgatgataacccagtagcaaaaacatttgtactgagtggtacaagccttggggactgaaaaaaaaaagattaaaaccattaaaaagaaactcatttttacgctgaatgaacatttatatgattgcattgggaccagtcatttcctaagctacatatggccatcttgacagtgttttttcttttgtgtgtttaattattatgtgtaaatcataaagacaaataaatttcactgtgccacccagcata

SEQ ID NO: 180328 - DNA, 3596 bp, Homo sapiens
  Payload ID: 15518
  Gene Symbol: STK31
  Gene Name: serine/threonine kinase 31
  Uniprot ID: Q9BXU1
  ENST ID: ENST00000354639
  CDS Start-End: 465-3455
aaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcaggtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgc

SEQ ID NO: 180329 - DNA, 3326 bp, Homo sapiens
  Payload ID: 15518
  Gene Symbol: STK31
  Gene Name: serine/threonine kinase 31
  Uniprot ID: Q9BXU1
  ENST ID: ENST00000355870
  CDS Start-End: 120-3179
aacaccggatgatggcgcagcgctgtgcacgcaggcgcagtgtggggcccttgcggtcgaagctcacgcggtaagccgctgcacgtgtgctacggcgggcggagggccgaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatggctttctgttcaaaatcaggagtttgagataaataaagatggaatccccaaagtggatcagtttcatctggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgcacaaaa

SEQ ID NO: 180330 - DNA, 597 bp, Homo sapiens
  Payload ID: 15518
  Gene Symbol: STK31
  Gene Name: serine/threonine kinase 31
  ENST ID: ENST00000456014
  CDS Start-End: 93-570
gctacggcgggcggagggccgaaagtccagtatgtgggtccagggtcactcttctagagcttccgcaacggaaagtgtgaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcagg

SEQ ID NO: 180331 - DNA, 661 bp, Homo sapiens
  Payload ID: 15518
  Gene Symbol: STK31
  Gene Name: serine/threonine kinase 31
  ENST ID: ENST00000444333
  CDS Start-End: 381-661
aaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaatttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatgg

SEQ ID NO: 180332 - DNA, 3085 bp, Homo sapiens
  Payload ID: 15518
  Gene Symbol: STK31
  Gene Name: serine/threonine kinase 31
  Uniprot ID: Q9BXU1
  ENST ID: ENST00000433467
  CDS Start-End: 12-3002
gaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccagagtatcaatagaaataaggatatcatgaagattggttgctcactgtctgaagtttgcccccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaaggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcagcaagagaaggcagctgctgtggatttgactaaccacttagaatacactctgaagacctatatagataccagaatgaaaaatctggcagctaagatggaaatactgaaagaaatgaggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtgagtgaagggaatattttgattgcccaaagaaatgaaatgcagcagaagctgtacatgtcagtagaagattttattctggaagttgatgagtcatctcttaataaacgcttaaaaacattgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtttttgacctatctgtggaaggatcactgatttcagaagacgcaatggataatattgatgaaatcctagagaagactgagtcaagtgtctgcaaagagctggagatagctctggttgatcaaggtgatgcagacaaggagataatttcaaatacatatagtcaagtactgcaaaagattcattcagaggaaaggctcattgccacagtacaagctaagtacaaggacagtattgagtttaaaaagcagcttattgaatatttaaataagagtcccagtgtggatcacttgctatccattaagaagacattgaaaagcttaaaagctctactcagatggaaattggttgaaaagagtaatttggaagagtcagatgatcctgatggctctcaaattgagaaaataaaagaagaaataactcagctgcgcaataatgtctttcaggaaatttatcatgagagagaggaatatgagatgctaactagtttggcacagaaatggttccctgagctgcctctgcttcatcctgaaataggattactcaaatacatgaactctggtggtctccttacaatgagcttggaacgagatcttcttgatgctgagcccatgaaggaacttagcagcaagcgtcctttggtacgttctgaggttaatgggcagataattctgttaaagggctattctgtggatgttgacacagaagccaaggtgattgagagagcagccacctaccatagagcttggagagaagctgaaggagactcagggttactgccattgatattcctgtttttatgtaagtctgatcctatggcttatctgatggtcccatactaccctagggcaaacctgaatgctgttcaagccaacatgcctttaaattcagaagaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtgagtcagcgagcctcggtgaacatgatggttggtgacttgagtttgatgtcacctgagttgaaaatgggaaaacctgcttctccaggttcagacttatatgcttatggctgcctcttattatgggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctggga

SEQ ID NO: 180333 - DNA, 573 bp, Homo sapiens
  Payload ID: 15518
  Gene Symbol: STK31
  Gene Name: serine/threonine kinase 31
  ENST ID: ENST00000422637
  CDS Start-End: 153-573
gcagtgtggggcccttgcggtcgaagctcacgcggtaagccgctgcacgtgtgctacggcgggcggagggccgaaagtccagtatgtgggtccagggtcactcttctagagcttccgcaacggaaagtgtgagtttttcaggaattgttcaaatggatgaagatacacattacgataaagtggaagatgtggttggaagtcacatagaagatgcagtaacattttgggcccaggccagttcagttttggggaatcttgacccaaacaagatttatggtggattattttctgaagatcagtgttggtacagatgcaaagtactgaaaatcatcagcgttgaaaagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcagggcacaacctttttggggagcttgatttttgaaaaggaaataaaaatgagaattaaagcaacctctgaag

SEQ ID NO: 180334 - DNA, 563 bp, Homo sapiens
  Payload ID: 15518
  Gene Symbol: STK31
  Gene Name: serine/threonine kinase 31
  ENST ID: ENST00000531170
  CDS Start-End: 436-563
aagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtggtttttcaggaattgttcaaatggatgaagatacacattacgataaagtggaagatgtggttggaagtcacatagaagatgcagtaacattttgggcccagagtatcaatagaaataaggatatcatgaagattggttgctcactgtc

SEQ ID NO: 180335 - DNA, 5393 bp, Homo sapiens
  Payload ID: 15519
  Gene Symbol: STK32A
  Gene Name: serine/threonine kinase 32A
  Uniprot ID: Q8WU08
  ENST ID: ENST00000397936
  CDS Start-End: 334-1524
gtgcgctgggcggcgctcggaccccttggcagccgcaggtgcctccccagcccagcccagctcagtccagcgcagcccagcccagcccagcccggcgctcgcagcctccgccgcttccgggcagataggtgccttttcttgctccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcagacatgtcttcttcaagagcaccttgactctgtccagaaggagttcataattttcaacagagaaaaagtaaacagggactttaacaaaagacaaccaaatctagccttggaacaaaccaaagacccacaaggtgaggatggtcagaataacaacttgtaaaggcctcatgtcttcttcttgggacaatctcatgccagaaacttctaattacatatgtcaagaaaagctgacagtagttcttgccactccacacaccatgacttagaaaatgtgaatgaatatatttcaaaaaaggcagcacaacacagtgaagggtcctgggcctgagctcctgggatgtcatttcacatcaatcaactgtgtgatctagagcaagtcacttagccactttctgtgctttactttatttatctaaaatgagagggttatactagacgagccataccctgcctttttagtgctatagttgttattctaaaccgcctttatttttattttaaaattaatatatgaatatagatttatttttccactccttctaattatgcagtgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccacggaaactggtaaatgctcgttttttccctcctaacaagtgaattgctaaatattagcccaccactccttccaagaagcatgttccttgagggctaattgtcctctgaagattagcagagacctgtatctggagaggatcagaaaagaatgtcatcacactgaaagtatgtccaccttgcagttcagaaaagttgcatcttatatggggtttattgtctaagttagaaatgaatttagaagatagtaaaatttaccgttgaaaaaccccttaaattacccataaagtatatgggaagtatcttttctcagtaaagcccaatacagtgtcacctttcactaatgaaacaagccattgcttttgttttgttttgacttagttatttttatttttggtctcattttggctaataccagatgagctaaaatgttgaacaaattatacttgtttttatagactagaattactcttttttttcttttcaggcagagtctcactctgtcacccaggctggagtgcagtggcatgatctctgctcactacatctgcctcccgggttcaagtgattcttgtgtctcagcctcctaagtagctgggatcgcatgtgtgtgccaccatgtgtagctaattttttgtatttttagtagagataggattttgctaagctggccaggttggtttcaaactcctggtctcaagtgatccgcccaccttggcctcccaaagtgctgggattacaggcgtgagccaccaaacctggccttagaattactcttagaacagtggaatgcccacacatccaagacaggcaagttcatggagactaagggaacagtggtatcatgtctcccttctcccttgtgcttactacaagaatggcaggcagaattccctacttatttaaaatatcactgatgtctcactctttttctttatattttatttattgatttgccacaaagtttaattcacctaagtgagacgtgcatatgatgtaactccactgtacagatacacagatctttacagaagaactatttttggcaacccctatgcccctgggtagggtccagaagtgaacaggcttggtgggggattgttttcacctcttggctactcagagtacctaaacctgtccttacttatggagagcatgtgtcacaccaagatggcagtaagctggcaactgcgaagacctgactgatgcccatttgggaagccaggcaagtgaaaatggaccgaagaaacagagatggctgtcttttatgcagggcttttccataaagaggttacactggggcaaccaagtatgtgtagaaagccagagctaaacttcagcttggcattcacagttttctcttcactgagctaataggcccagagtttcgggcagagctgtgaaatagtgcttctctaatagcaaccatattattgttacataattaaaagccagctcttttgttgtttgtttgattccttttccctacagttcccacatcatttgtctgtgctattctgtttttctccaaacactataaacttgaagcaattgccctgactcgatttcagagaaggggatgtgttggaaagagcaagaataagaaagtgaccagattctgctgcagtctggtaaccccacgagtgtcagggactacttgcatgtttacttctatccttcatttgttttgattcaagcctttatgtgctgtggactcacctccctaagtaaccaggttcctcctctcgctgcaaccttgtttgcatccttcccaagaagaggctttgggaaatttttctgtaattacacttaccaaagagccatggaaccattaggatctccactgtgatgagagttaagccatagtgccatttcacacgtatacatttatgatgggatgggaacccgatacaatctctgtaggctgaatccctagttttatttccagtgagctgcttctgtgactgaagcacctctgtgggcttttgggaaccatggatgcacagatgagagagcacaggctcagagagtaagatggatttctagtgctagccaggtgaatgacacacagtgtatttcaagtttgaaaagcaaaaccatggtatctgacagtgctgattgtaatcacctcccaccactgtgcattttaaacatgagaacaaaaaacttttccaaaatttaaacttttcctaaatctttgtggtcattgctagttgttgacatcagatcctttggttttattctataacttgggctaaacgttaatatcccactaggtggaacatgtctcttccggagttgtgacaaccgaggctcagagctgtgatttttagaaaacaagatgactattaaatcctttggcctggtattcttgaatgtttttctcccagtgcttcccttgcctgtatggagcatctgcaaagtctgagcaggttttgaagtccaagagcatcccagctataaggctcttgcactgtgacagagctgcccacctccagtacaccctcagtgacctcgagtagatgcgtagggcagtcaaacccggcaacttatgccacaaccctaattccaggaagtcgtctgctaatggctaacccactgccatggtggcactggttttgcctgaggtcattgctagggcaggaatgaacagcaaccagcacagagcattgctaaattaattacagtaatctaattaattagtagctaggcttcttctgataggaaagtttcaaccagaaaccactagatgttctattatcatagcttttgtagattggatggaagaataagtaggaagaaagagtattaatgtagctagtagggaccagtgttgctgcttgtggctgaggcagtaatgctaaggctttagctcttcaaaagcagaatgaaaaggcacaaaaagcacttcaagcttgtttctgtacccagttgtccctgtattgtctacataaaatcctgtttcctgctatctgtctgtgattcctgtttattacaaattcagtgtgtctgactgatattaaacactgatattaaaatttcaaacttcacttatctgtgctgttgtgaacaggcagctgatctggcagccctcgaatgggaaacaagtgcttctgttgagctgtagcatatataatataaatgtgcctatgtgtattaaaatgtcttctgtaaacaa

SEQ ID NO: 180336 - DNA, 1637 bp, Homo sapiens
  Payload ID: 15519
  Gene Symbol: STK32A
  Gene Name: serine/threonine kinase 32A
  ENST ID: ENST00000398523
  CDS Start-End: 172-1395
ctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgggcacgtgcacatcacagatttcaacattgctgcgatgctgcccagggagacacagattaccaccatggctggcaccaagccttacatggcacctgagatgttcagctccagaaaaggagcaggctattcctttgctgttgactggtggtccctgggagtgacggcatatgaactgctgagaggccggagaccgtatcatattcgctccagtacttccagcaaggaaattgtacacacgtttgagacgactgttgtaacttacccttctgcctggtcacaggaaatggtgtcacttcttaaaaagctactcgaacctaatccagaccaacgattttctcagttatctgatgtccagaacttcccgtatatgaatgatataaactgggatgcagtttttcagaagaggctcattccaggtttcattcctaataaaggcaggctgaattgtgatcctacctttgaacttgaggaaatgattttggagtccaaacctctacataagaaaaaaaagcgtctggcaaagaaggagaaggatatgaggaaatgcgattcttctcagacatgtcttcttcaagagcaccttgactctgtccagaaggagttcataattttcaacagagaaaaagtaaacagggactttaacaaaagacaaccaaatctagccttggaacaaaccaaagacccacaagtgacaaatggacaaatggacacaggactcagtgagacttttcagacctcgaaagtttcataaagtggtcagaatgccccaggctacttggataaagataaggaattctatcagggaggcatgaatggaatcagattaaaagtaacagagatggatgagggccttccagtgatatgcgtgaatcagcattagatccgcttatctcagctggcaggagcctgctgtgcacaccacttcccagctccctcttcaacaatgtgaaagtggtaacttgaaattggtaataatgggagcatttacaccac

SEQ ID NO: 180337 - DNA, 798 bp, Homo sapiens
  Payload ID: 15519
  Gene Symbol: STK32A
  Gene Name: serine/threonine kinase 32A
  Uniprot ID: Q8WU08
  ENST ID: ENST00000626951
  CDS Start-End: 191-691
ccttgctcttggagttcttctcttagtccctgttccctggatgaaagcatcgctccgagcctcatgggaggaatgaaggaagaatcgagactagatatccaactaaggcttcgggacatgttttgagcgaagatgggtgtttctgcccggatagtataaatcgaggatccaggtctgggcagattcaaccatgggagcgaacacttcaagaaaaccaccagtgtttgatgaaaatgaagatgtcaactttgaccactttgaaattttgcgagccattgggaaaggcagttttgggaaggtctgcattgtacagaagaatgataccaagaagatgtacgcaatgaagtacatgaataaacaaaagtgcgtggagcgcaatgaagtgagaaatgtcttcaaggaactccagatcatgcagggtctggagcaccctttcctggttaatttgtggtattccttccaagatgaggaagacatgttcatggtggtggacctcctgctgggtggagacctgcgttatcacctgcaacagaacgtccacttcaaggaagaaacagtgaagctcttcatctgtgagctggtcatggccctggactacctgcagaaccagcgcatcattcacagggatatgaagcctgacaatattttacttgacgaacatgatacctggctctcctacaagtcccactgaattggagtttcaggagaccgaagcccaggcacatgtattttgcaaaactacactgaagtttctgataatgacggatatcaacaattaaacgcttacttcttgccaaa

SEQ ID NO: 180338 - DNA, 3582 bp, Homo sapiens
  Payload ID: 15520
  Gene Symbol: STK32B
  Gene Name: serine/threonine kinase 32B
  Uniprot ID: Q9NY57
  ENST ID: ENST00000282908
  CDS Start-End: 423-1667
ctgcgtgctgccttcgtccgtcccctcctcccccgctccttcccctccttcccctgctcccgcgccgcctcgcgtctcccgcccgctgtagccggcgaggagcgccgcacgttggccccggcgcgaggagctcccgggttcccgggcgggcactggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattccttc

SEQ ID NO: 180339 - DNA, 3241 bp, Homo sapiens
  Payload ID: 15520
  Gene Symbol: STK32B
  Gene Name: serine/threonine kinase 32B
  Uniprot ID: Q9NY57
  ENST ID: ENST00000510398
  CDS Start-End: 233-1336
gtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctgtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttgg

SEQ ID NO: 180340 - DNA, 1989 bp, Homo sapiens
  Payload ID: 15520
  Gene Symbol: STK32B
  Gene Name: serine/threonine kinase 32B
  ENST ID: ENST00000512018
  CDS Start-End: 269-424
ggagtaaggagctgcgagcgcagcccgaggcggggcacggcggaaggcgcggcgagagcggggtccctgcgagcgcagtcggaagggcgtccaggagaagggggacgccgtccccgcccctgcacggtgctcggccccctcgggctccgcgcgcggctacaacccggactgggcgcgcccccggcatcccgcatctctgcgcgcgtcccacatcccgcatccggcatcccagcggccgggcatgtagcagcggcagcaacggcggaatatgggcgggaaccactcccacaagccccccgtgtttgacgagaatgaggaagtcaactttgaccattttcagattctgcgggccattggtaaagggagttttggaaaggattgccaatgccgtttgttccttgagaatctaagtgaggaaagttgaaaaaaaacccataaacatcacaaaggcagctctttccagcaacatagacgtttgttgttttggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacggacatgttcacattacagacttcaacatagcgacggtagtgaaaggagcagaaagggcttcctccatggctggcaccaagccctacatggctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtga

SEQ ID NO: 180341 - DNA, 3272 bp, Homo sapiens
  Payload ID: 15520
  Gene Symbol: STK32B
  Gene Name: serine/threonine kinase 32B
  ENST ID: ENST00000512636
  CDS Start-End: 348-1361
gggatttactggcaaggccgtacattgttgacctgtcttggtgtagggaaacatgtagaagccaggcagaagtggggtagagagtgaagcagcaagactgcagagcctcatcaagaagtgtggagtgaagggaaggcttcagatggacaatttgtgtgctggggaaaaaatggaatgtgctgcaaattcccctgtggataagggtggacggctgctctggcaagtatagtgcacctgacccaagagcctttggaatagtcaactttgaccattttcagattctgcgggccattggtaaagggagttttggaaaggtatgcatcgtgcagaagcgagacactaagaaaatgtatgcaatgaagtacatgaacaagcagaagtgcatcgagagggatgaggttcggaatgttttccgggagctgcagatcatgcaagggctggagcaccccttcctggtcaatctgtggtactccttccaggatgaggaggacatgttcatggtggtggacctgctcctgggaggcgacctgcgctaccatctgcagcagaatgtgcatttcacagaggggactgtgaaactctacatctgtgagctggcactggccctggagtatcttcagaggtaccacatcatccacagagacatcaagccagacaatatcctgctggatgaacacgctccagaagtattccaggtgtacatggacagaggccccggatactcgtaccctgtcgactggtggtccctgggcatcacagcctatgagctgctgcggggctggaggccgtacgaaatccactcggtcacgcccatcgatgaaatcctcaacatgttcaaggtggagcgtgtccactactcctccacgtggtgcaaggggatggtggccctgctgaggaagctcctgaccaaggatcctgagagccgcgtgtccagccttcatgacatacagagcgtgccctacttggccgacatgaactgggacgcggtgttcaagaaggcactgatgcccggctttgtgcccaataaagggaggttgaactgcgatcccacatttgagcttgaagagatgattctagaatccaagccacttcacaaaaagaagaagcgattggcaaagaacagatccagggatggcacaaaggacagctgcccgctgaatggacacctgcagcactgtttggagactgtccgggaggaattcatcatattcaacagagagaagctcaggaggcagcagggacagggcagccagctcttggacaccgacagccgagggggaggccaggcccaaagcaagctccaggacgggtgcaacaacaacctcctcacccacacctgcacccgtggctgcagcagctgagcccacacttgttgctgctcaacaggactgcactcgtctctgccctgcccacccagagcccctctttgtgccctgatggtccctgtctcacccctgaaaacatcagatgcagaaaaagccctggacttggagctgggaagcctgggttctggtcccatctccatgactgattcacgtgtgacctcagacaagtcacgccctctctgtgcctccgttttctgcatctgccaaaggggttaaacacttctgccccacttcaaattacaagattatggggagaacccaattaggtaggaaacatgaaaaacctttgatatttataaaatcatttttacgtgcaaaatataaccttaatatttgaagtgacccccattccccaaagcaatcaaaccgtcatgactttgcaatttggcacatcctagcttgttagagggcacttccgaaaaacacagccctgacagcaaaataaaggtctgatatgttggccccttctatggaaacaacgctgccaaatcctggagcaaaacctgaagtgtcttcatgtgcattctctggcaggccacagtcctgagcttgtaagatggtgcagcatgcagaccagacttgtccccaaggtctcagcgctgcggtctcactcctcccctcatttaagaagactatccttaccttttagtttcagcagtcctcaccaccaccatatccccagtgctgggatggcacacaggtgtccattcagatgagagttgggtcgctgagcattggttactcctgcagagtgtaatcagcaccccatccaactggcccgaaagcccagacctgcagcagaactctccaactctctatcagctttcagggttttctctcctgggaagggtgtaaaatcagcttgtcagattcttcttacagagagtatccaatcggtattggtggagcggctccctatttatacaataggaagcatgggtgcttagaaagtttatttcaggaggaaaatgggttcacacaaaaagcaaactacattctggtctgctcagggagaagcttgcctttgaactggaagatgttgggatgagcagggaaagcttagactttggagtcaggtttgtgttcagaatccagccctgctggctactaactaactgggagaccttaggcaaagcatgcaatcgctctgaatggcagtttcctcatttttaaacagggataataaaactaatattgcaggggagttacagggttaaataagatcctgtgtgtaaccccaagcattggatgactcatagaatggccttttttgtcagcataatcgtcatcattatttagatactttcttccttcactcacccagcaggtcagttttctgtgcaaacaaacctgtttaggattcttccaaatgttcttcctggggtctttgatatttgtttgttacatcctgctgaagttcgactgtgtttttattttttcatccaacttccatttttcactttttacatgattactcaatccttggggctgtccatgtcatctcttagatttcttaaaagacattttaatgtatggttaggttttatatttttattttttaaaaaagaaatagtcagtgttttcctcctttcaaccgagactatttctggattgtgtgctcctcgtcagttgacttgttttgcacacttttctttacttcatgtccccatcaacaaccgtcctgctccccacctcccccaggaaataaggggcctgctcctctccctactgtgaccctggaggctcttaagatgatgatggttttttttattgggctgagttcacgaattaggggcaggagctggaagtcgccctaggaacaccagatttcctggttctgttcaagttggcatttcttgtttggaataaactatttcttggacattc

SEQ ID NO: 180342 - DNA, 2086 bp, Homo sapiens
  Payload ID: 15521
  Gene Symbol: STK32C
  Gene Name: serine/threonine kinase 32C
  Uniprot ID: Q86UX6
  ENST ID: ENST00000298630
  CDS Start-End: 108-1568
acggcgggcgctgccggccccgagcgctcccgctaccactgccgctcccggccctgccggccggccatgccccgagttccggctgccgcgcgcacccagacccggcgatgaggagtggcgccgagcgcaggggcagcagcgccgcggcgtccccgggctcgccgccccccggccgcgcgcgccccgccggctccgacgcgccctcggccctgccgccgcccgctgctggccagccccgggcccgggactcgggcgatgtccgctcgcagccgcgccccctgtttcagtggagcaagtggaagaagaggatgggctcgtccatgtcggcggccaccgcgcggaggccggtgtttgacgacaaggaggacgtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgtctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcaggtcttggaggtcaagggcatgggttggggtagtgggtggggaggtgaatgttttctagagattcaaactgctccagcaatttctgtagttttcacctctgagaattacaatgtgagaaccgct

SEQ ID NO: 180343 - DNA, 733 bp, Homo sapiens
  Payload ID: 15521
  Gene Symbol: STK32C
  Gene Name: serine/threonine kinase 32C
  ENST ID: ENST00000368619
  CDS Start-End: 96-536
gcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagtcttctgagagcacaccccaggactgggattttgccaggaagatgtggaatggtgtggaaagacaagaagctgcagccttcaggctgccatgaaaaagctgggggtgtgttctgtggcccatcaagagggggtgtgtaatgaattgttaatgaatttctcagatgagccaaagtggtgaacttgtctcagtacccagggagactcagactcatccccagctcttggcctccattttcccagctgctgtgattggagtgggtccctggaattcatatgctggaaatttggtccaggtgtgggtgtgttgggaggtggggtttaaggtgtggttaggc

SEQ ID NO: 180344 - DNA, 830 bp, Homo sapiens
  Payload ID: 15521
  Gene Symbol: STK32C
  Gene Name: serine/threonine kinase 32C
  ENST ID: ENST00000368620
  CDS Start-End: 112-830
ccgtttttccgcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcatgaacttcgaccacttccagatccttcgggccattgggaagggcagctttggcaaggtgtccccacgtgtccccaggcgtcctcaggcgtcctgccgaacagccctgtgccctccaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacc

SEQ ID NO: 180345 - DNA, 2010 bp, Homo sapiens
  Payload ID: 15521
  Gene Symbol: STK32C
  Gene Name: serine/threonine kinase 32C
  Uniprot ID: Q86UX6
  ENST ID: ENST00000368622
  CDS Start-End: 383-1492
gtactttgcagttagagaggcgctcacctgtgccgcccgagtgcgagtgaggctcctgccccacaggtggcggggcccggccgctcagaggctcagtctccttggtgaccgcgcggtgtccatcctctgctcacccatgtgcgctggaggcagggccaggccgttgtgcaaagacctgccctgccaggaacgagtgcgctgctgagtcctgtagataaagccgccaaccccggggactggtgtctcctgagtgaccgtgcagccgtgggcgccatagaaagcagagaaggcagtgaacttcgaccacttccagatccttcgggccattgggaagggcagctttggcaaggtgtgcattgtgcagaagcgggacacggagaagatgtacgccatgaagtacatgaacaagcagcagtgcatcgagcgcgacgaggtccgcaacgtcttccgggagctggagatcctgcaggagatcgagcacgtcttcctggtgaacctctggtactccttccaggacgaggaggacatgttcatggtcgtggacctgctactgggcggggacctgcgctaccacctgcagcagaacgtgcagttctccgaggacacggtgaggctgtacatctgcgagatggcactggctctggactacctgcgcggccagcacatcatccacagagatgtcaagcctgacaacattctcctggatgagagaggacatgcacacctgaccgacttcaacattgccaccatcatcaaggacggggagcgggcgacggcattagcaggcaccaagccgtacatggctccggagatcttccactcttttgtcaacggcgggaccggctactccttcgaggtggactggtggtcggtgggggtgatggcctatgagctgctgcgaggatggaggccctatgacatccactccagcaacgccgtggagtccctggtgcagctgttcagcaccgtgagcgtccagtatgtccccacgtggtccaaggagatggtggccttgctgcggaagctcctcactgtgaaccccgagcaccggctctccagcctccaggacgtgcaggcagccccggcgctggccggcgtgctgtgggaccacctgagcgagaagagggtggagccgggcttcgtgcccaacaaaggccgtctgcactgcgaccccacctttgagctggaggagatgatcctggagtccaggcccctgcacaagaagaagaagcgtctggccaagaacaagtcccgggacaacagcagggacagctcccagtccgagaatgactatcttcaagactgcctcgatgccatccagcaagacttcgtgatttttaacagagaaaagctgaagaggagccaggacctcccgagggagcctctccccgcccctgagtccagggatgctgcggagcctgtggaggacgaggcggaacgctccgccctgcccatgtgcggccccatttgcccctcggccgggagcggctaggccgggacgcccgtggtcctcaccccttgagctgctttggagactcggctgccagagggagggccatgggccgaggcctggcattcacgttcccacccagcctggctggcggtgcccacagtgccccggacacatttcacacctcaggctcgtggtggtgcaggggacaagaggctgtgggtgcaggggacacctgtggagggcatttcccgtgggcccccgagacccgcctagatggaggaagcgctgctgggcgccctcttaccgctcacggggagctggggccatggatgggacaggagtctttgtccctgctcagcccggaggctgtgcacggccctcgtcacaaggtgacccttgcagcacaggccgcgggtgccccaggctcggctcaggtcttggaggtcaagggcatgggttggggtagtgggtggggaggtgaatgttttctagagattcaaactgctccagcaatttctgtagttttcacctctgagaattacaatgtgagaaccgct

SEQ ID NO: 180346 - DNA, 607 bp, Homo sapiens
  Payload ID: 15521
  Gene Symbol: STK32C
  Gene Name: serine/threonine kinase 32C
  ENST ID: ENST00000456004
  CDS Start-End: 102-410
gcgcccgcggccttgaaggggtggtggtcgacgggcaagtagagaccgcgagggtctggaggggcgaccggcctggcacagaggggaaggaagagagcgggatgctaagtgccgtctggggagccggagggcccggggcgggcggggctgctcgaggacagccgagcagaaaagaattgctgctgaggcaccacctttggagcggtcctcgctgcctgtccttcccgctgggctcactccccgcgtctctcctggggcttcctggagccacttcccacaggagctgcttgtccccaaatcttgcctcaggacttgctgccaggggaacgcagactcagagcgtcctctttggagaagtaaggctgcctctggacggaggagtgaggggggcgaggaaacgcagaagctgaaagcacaaccagtaccttctcaggagcgtggggaggccagccacccgggcagagcaaggagagaatgaggagtgacatgggtgttgccgtgagtggcgaaggggatggaagatttcagcacgatgctatttctaacaagtttcagcattccagtatctcttttcacaaataaaacatttactaaccatttgagcgta

SEQ ID NO: 180347 - DNA, 2707 bp, Homo sapiens
  Payload ID: 15522
  Gene Symbol: STK33
  Gene Name: serine/threonine kinase 33
  Uniprot ID: Q9BYT3
  ENST ID: ENST00000315204
  CDS Start-End: 524-2068
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggaccttcctctggggttagttctctggtgccaccttcagtgatctgtgtggcagctctgctgctcacttctggctttactgggttttggtatttaactgttgcttacgcacactggaaattttcacctgcagtttttcttctgcctaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 180348 - DNA, 1991 bp, Homo sapiens
  Payload ID: 15522
  Gene Symbol: STK33
  Gene Name: serine/threonine kinase 33
  ENST ID: ENST00000358872
  CDS Start-End: 369-1352
gctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 180349 - DNA, 2558 bp, Homo sapiens
  Payload ID: 15522
  Gene Symbol: STK33
  Gene Name: serine/threonine kinase 33
  Uniprot ID: Q9BYT3
  ENST ID: ENST00000396672
  CDS Start-End: 375-1919
gccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 180350 - DNA, 946 bp, Homo sapiens
  Payload ID: 15522
  Gene Symbol: STK33
  Gene Name: serine/threonine kinase 33
  ENST ID: ENST00000418597
  CDS Start-End: 300-946
aggccgttgctatggcaacgcggtggaaaaacgggcctctgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtgggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaat

SEQ ID NO: 180351 - DNA, 758 bp, Homo sapiens
  Payload ID: 15522
  Gene Symbol: STK33
  Gene Name: serine/threonine kinase 33
  ENST ID: ENST00000431279
  CDS Start-End: 568-758
tgggtatctcgctgccggccggctggtaaccccccagcggagggaccgggccgagcccgcggacccctccgagtgtctcctggggcccagccgttggtaccccatttcccccgggtccggtatttggggtggtctctgtctgccccggttcatctccaccgtctcaccttcaccccatcttgggacgtgaaactttttgaaagtttagaagcgaacttactgtggggcagggccactacttctcagcacatccggccttctggctcatctcctccctgcatctcactacgcccctccccactccagggcctgaagttaaatcattttggaaagtgatacaggagaggactctgctatgaaacttcctgagtgaaatgataagtggcatgaagaaaaacaaagcaagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaa

SEQ ID NO: 180352 - DNA, 562 bp, Homo sapiens
  Payload ID: 15522
  Gene Symbol: STK33
  Gene Name: serine/threonine kinase 33
  ENST ID: ENST00000454443
  CDS Start-End: 450-562
gtgcagccggcacctcccggccaaccccgcggcttggagaaggggctttgcacccgccgccgctgtttgtcctcgcgcggcccccgtccactgccctgcggttgctctgcgggctgaaaagtttctcccggtgcagaattccgggctcagcgacagcctgcgccgagtgtgcgcacctgtcggagacccgccagtccgccggccgcggcagggccactacttctcagcacatccggccttctggctcatctcctccctgcatctcactacgcccctccccactccaggctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagtttt

SEQ ID NO: 180353 - DNA, 709 bp, Homo sapiens
  Payload ID: 15522
  Gene Symbol: STK33
  Gene Name: serine/threonine kinase 33
  ENST ID: ENST00000457885
  CDS Start-End: 196-709
gcctgaagttaaatcattttggaaagtgatacagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaac

SEQ ID NO: 180354 - DNA, 767 bp, Homo sapiens
  Payload ID: 15522
  Gene Symbol: STK33
  Gene Name: serine/threonine kinase 33
  ENST ID: ENST00000422559
  CDS Start-End: 194-767
ggtgcagaattccgggctcagcgacagcctgcgccgagtgtgcgcacctgtcggagacccgccagtccgccggccgcggcagggccactacttctcagcacatccggccttctggctcatctcctccctgcatctcactacgcccctccccactccaggcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatg

SEQ ID NO: 180355 - DNA, 1243 bp, Homo sapiens
  Payload ID: 15522
  Gene Symbol: STK33
  Gene Name: serine/threonine kinase 33
  ENST ID: ENST00000444064
  CDS Start-End: 1-612
gttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacatctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgt

SEQ ID NO: 180356 - DNA, 3103 bp, Homo sapiens
  Payload ID: 15522
  Gene Symbol: STK33
  Gene Name: serine/threonine kinase 33
  Uniprot ID: Q9BYT3
  ENST ID: ENST00000447869
  CDS Start-End: 920-2464
atgtactcccaattacttctggaagtttctcaaagtactcctttatatgtactgcagagtgtatttttcttcctcctcaactgagatctttccaacttgccaccatgcagctgccaatggtcctagttaagtaaaatgctgccatacctattttagactcagggaaaaatagcacccactcatttttatttttgctcaatataaaaatgaggatacttatgaggatacttaaacttttaggattagctagttttctaaaaatcgaattattcactcctttgtaaagtatgtaataggaatttgctctaataatcaatagattaaggtttaaaatttgaaaccatagtaatgtatgtttaacaccaatattttaagcctttttaaaaaccacaacccacattaagaaatacatttcatactgtgatcaagtacacacgcacacacacactctatacatatatgtctgtccaattaaaagtttcacagaaatttccaaggaggtatgctaaatattatctctttgattctactttatttttaaaaagtggtatcaacccacaaaatggatttcataacccactacgcagtttgataagatgctgttttagaccatgcttttcaccagttttgtggtcctattttgtccttttcatgtctatacaggatgcttctagtgctagttgctagcttttctctgatttccaggatggtaataggttaagaatttctctaaatggttatttcttttctttctgcagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttccagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttcaaattcttatgtttaggcacagctatttataggggaaaacaagaggccaaatatagtaatggaggtgccaaataattatgtgcactttgcactagaagactttgttagaaaattactaataaacttgccatacgtattacagcagaagtgcttcagtcattcacatgtgttcgtgagattttaggttgctatagattgtttaagacagcttattttaaatgtagaaaaataggagattttgtaactgcttgccattaacttgctgctaaattcccaatgtattgattaaatcaataaaaaacagatgttactcagc

SEQ ID NO: 180357 - DNA, 582 bp, Homo sapiens
  Payload ID: 15522
  Gene Symbol: STK33
  Gene Name: serine/threonine kinase 33
  ENST ID: ENST00000526360
  CDS Start-End: 496-582
acacaggagggatgggtcggcagagtttgtaagtttggatgggtaataacttaacccaggggattgttggtggaggaacgagggagtcctgtagctagagataggcagaagcagacaggatatttgggttctaggtaagcaaggtgcatctaagacctaagaagtcttcagaggcagcagagacgaacaaatgaacgtgaaggcagggccactacttctcagcacatccggccttctggctcatctcctccctgcatctcactacgcccctccccactccagggtaaattccaataatgctgctctgttccagatggagttcatgttgactgagctctcacgtgtgaatatgtgtctagtgcatccttaacctgaggacttcaccagttcgaaattacagttttcaccatcaactaccttatcctttttggcctggttttcttcctcaaacagtggaaacatttttaaagttgcttttgttgcagagttaaacaaatggctgatagtggcttagataaaaaatccacaaaatgccccgactgttcatctgcttctcagaaagatgtactttgtgtatgttcc

SEQ ID NO: 180358 - DNA, 1895 bp, Homo sapiens
  Payload ID: 15522
  Gene Symbol: STK33
  Gene Name: serine/threonine kinase 33
  ENST ID: ENST00000534493
  CDS Start-End: 151-1572
agaattccgggctcagcgacagcctgcgccgagtgtgcgcacctgtcggagacccgccagtccgccggccgcgatggggagccagataaacgttacataactagaaagtggcagagcaaaacaagggttcctccagttttggtggtggaaatgtcacagacatcaagcattggtagtgcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggaaatctatacctttggaagaatattgggaaaagggagctttggaatagtcattgaagcgacagacaaggaaacagaaacgaagtgggcaattaaaaaagtgaacaaagaaaaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgactatagccagcagtgtgacatttggagcataggcgtcgtaatgtacatgttattacgtggagaaccaccctttttggcaagctcagaagagaagctttttgagttaataagaaaaggagaactacattttgaaaatgcagtctggaattccataagtgactgtgctaaaagtgttttgaaacaacttatgaaagtagatcctgctcacagaatcacagctaaggaactactagataaccagtggttaacaggcaataaactttcttcggtgagaccaaccaatgtattagagatgatgaaggaatggaaaaataacccagaaagtgttgaggaaaacacaacagaagagaagaataagccgtccactgaagaaaagttgaaaagttaccaaccctggggaaatgtccctgatgccaattacacttcagatgaagaggaggaaaaacagtctactgcttatgaaaagcaatttcctgcaaccagtaaggacaactttgatatgtgcagttcaagtttcacatctagcaaactccttccagctgaaatcaagggagaaatggagaaaacccctgtgactccaagccaaggaacagcaaccaagtaccctgctaaatccggcgccctgtccagaaccaaaaagaaactctaaggttccctccagtgttggacagtacaaaaacaaagctgctcttgttagcactttgatgagggggtaggaggggaagaagacagccctatgctgagcttgtagccttttagctccacagagccccgccatgtgtttgcaccagcttaaaattgaagctgcttatctccaaagcagcataagctgcacatggcattaaaggacagccaccagtaggcttggcagtgggctgcagtggaaatcaactcaagatgtacacgaaggttttttaggggggcagataccttcaatttaaggctgtgggcacacttgctcatttttacttc

SEQ ID NO: 180359 - DNA, 635 bp, Homo sapiens
  Payload ID: 15522
  Gene Symbol: STK33
  Gene Name: serine/threonine kinase 33
  ENST ID: ENST00000524760
  CDS Start-End: 1-635
gcagaatctttaatttcactggagagaaaaaaagaaaaaaatatcaacagagatataacctccaggaaagatttgccctcaagaacctcaaatgtagagagaaaagcatctcagcaacaatggggtcggggcaactttacagaaggaaaagttcctcacataaggattgagaatggagctgctattgaggctggaagctctgctgtgaagttacttgaacgagaggtgaacattctgaaaagtgtaaaacatgaacacatcatacatctggaacaagtatttgaaacgccaaagaaaatgtaccttgtgatggagctttgtgaggatggagaactcaaagaaattctggataggaaagggcatttctcagagaatgagacaaggtggatcattcaaagtctcgcatcagctatagcatatcttcacaataatgatattgtacatagagatctgaaactggaaaatataatggttaaaagcagtcttattgatgataacaatgaaataaacttaaacataaaggtgactgattttggcttagcggtgaagaagcaaagtaggagtgaagccatgctgcaggccacatgtgggactcctatctatatggcccctgaagttatcagtgcccacgacta

SEQ ID NO: 180360 - DNA, 6685 bp, Homo sapiens
  Payload ID: 15523
  Gene Symbol: STK35
  Gene Name: serine/threonine kinase 35
  Uniprot ID: Q8TDR2
  ENST ID: ENST00000381482
  CDS Start-End: 272-1876
gacaatcacccagtcagtatttattaggcgcctactgcggacggttggtcttcacgcagatcaggcgagaagggatagtgatgcgcgggccgctgcggagacccggagcccgccgcggatcacgggaatttcgcgcctattttttgttggctgggtgttctcgccagtgattgggtcccggcaaggcgtgccggtgcgctcggctgcggctgctccgtcgacctttgcaggaccgggcggtgcagggctcactcggctggcgtcccgggggatgggccaccaggagtctccgctggcccgggcgccggcgggaggtgcagcttatgtaaagaggttatgtaaagggctcagctggcgcgaacacgtggaaagccacgggagcctaggagcccaggcttccccagcgagcgccgcggcagcagaaggatccgctacacgccgggctcgggccgccacctcccgcgctgctcggtcccggaggcagcccgggcccggagcggaccatccccaggcaggggctccaggggggaaacgggccgcccggaagtggaggtgcgcgggccaggtcacaatccaaggtccggctcctccgcgtcccagggccggacggagggatgaggcagggggggcccgggcagcgccgttgctgctccccccgccgcccgcagccatggaaacggggaaggacggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactaggtcgattcctcgggacccacagtctcaccacgtctcctccagaggacggcagagggtacaggtggtggcctggccggttggcgatctcccgacagctggatccggcaatgtgaagcttttgtttgggtttccccgcttctttttagttttgctttatttttttccttttcttttcttttttttttttcctctttcctttttttaaatttaaaccattgagacttcagaagagcaggacacaatgctgtggacaggcaccaatttctttaaagaaattcaatgtgggcaaggcatatgtgtaaatttcacttttactttttataaggggttagggagctatttttggttttgtccttcactttccctctgtcttccttctttatacttttctcagttctacttatgacacctcacttccctagagaaggcctgcctccccatagggaatctgggggtttcttctggaacggggcgtgaggacacaaggaggcctctgggccacgcctccctaccagatgcaggaactcctggactccttggtgggctggccctggctagcccttgggcctcggagatgatcagaggtgaagaaccgcctggaagaggaaggccagggtttggccaggagaactaagaaggtctcaactccaggctttgttgtgtttaagctattgagagccccaggccacaccaggacttgcagtggtgggaatccattcctcttctgccctgtgttgcagggaactaggaggtaagggtggagggcgaccatctcgctcttgctggcggtggagcagccatccctgcctttctgttgggaaaaactgttgtgccaaactcttgtgtggaacacagctgggtcttcagcaggcatctgtcactgccgtgaggtcagcgcttctcacctaactgcctcctggattgtcatcttcccagatgtgtcccatagtgtccaggtgtcacagagacggcctgaggccctaagatctggttgtgactttgccatgataacagggtgtcctgaactggctgccgttgtcgtgttctcacagtgaagggcgtgccctgtgtgccggggtccatggtgtcatatgcagtgacacacactgtcaagcgccatttccctcacccctggagacttactgttaggtgcctgccctcagtatagacgtatccaatgggaaaacagcggacctgcccagagcagggaggtgtcgtggaactgggtagaccccctgcagcgttaggggcccatttgtgggctcgccaccttcaggcttccccagccatgacacttcagccccgccacccatgcctgtctgctgcagccatccttgcactctccagcgacactctcgcacctccctaggggaagcttccctccccctgggctgctgctctgagcccatctgttctccccctgcaagaaggggcaatgctcttgtgttgtccctctgtctggacgcgcctggccactccgaaggcttttcaccccattatggccaaatagtatagggccactggggagggggaagggaatcattttgtgttcatttttgttttctgtttcacctaaaccagcataggattgataggggagacggttggcgggcatttccgtttctatgtgaccaaggcagcaggggcttttacctgctaagcggcaatcctttggccctgagaatttgggagagaacagtgcatcaggccaggctcagcaatatgtttgctcacattctttcagccttctgtcacccccctcaacaccaaactttcttccttgtgagcagaaggttggctgctgttagcaggatcccacagtgataaccaggcccttcccttcctaagccaaaacccattgtgactgcctgtctctcctgtctctgacttctcaggcagcctcctgagtgcactgagttgtatccgagagggtgggaacagcagcatcccctaattgcagtacacggttccttttccgcccgccaccctgcctttccttgggggcagctgtctctctgtacatgagcaaatgggcaaaaacagtccccaaacccagcacccccctctccctggctgcagcccacactgtaacatccctagtgaggctccagcctaatgagccccttattttcttttttttccctccccaggtctagtagctctaactaaaaagttcttggagccatcgtgctccccctttgttatttttcttgctatcagagtagcaagaaacagcacccctgtaggtgacaggtgggcagcctggtaggggtcgccagcctccatgccccctcatcttccagttcttgcttagtggcacgacctctttccatagcataaatgcaggccagcgttttagccccaagtgcctgcccttgcttcttacccctcccctgctttctcaaacacttgcccacctcaggcactcagcgggctccgccgtggtgagagaactggccgtggctcagccccgggtagcacctgtagtttcagtgccactctccactgtccccttgtggaccagcttccactcactgtcacgtcccccctcctgcgtcttcactgggtctcaggctgccagcagctctctggtgcatcgtctcaacaccaccaagtttgtaggacctgcccaagttctagtagtattcaaaacttcaaacggcagtcatttgttctcctcggctctgtggcaaggatagccctttggagggggactcttgacctcggctgttagggatctgaacttggttttcccgtcagaagaatcagcaggacagatcgtagtgccttattccattgtcctcccctggccaggcctcctggctcagctggaagtgcatggcttctttctccctatctgtgtcctctgtcacttgctctttcactctctctctcattcccagagagccacgggggagggatcaccctcacccccaacaccctcttcctgagggctgtagccaggtccgcatctccccaccaccaccagggcactcactcgcagctatagcccaggacagaaaaactgtgctttggacaggtgcacactctctgcctcttacctctagccaggaggatgcctcagtctgttcattcgagactggccccgtctgaaccttctctgggcactggggactaaggttgcaggccttagcctcgtctcgtcccagaggcattggatcaggagaatgggaatttttttcctcccacctggacatagtttgcccctgtggctgcctttctgagggagtatactaaatgtttacttaagaaacaccctgtttacagccagaggagaaacacccaacactgagtggagatttgactctggacagggcctggcctccttagtggcactgccggggggccccagagcgaatgagggcagagatgcccggggcaggggcaaacgccctccgctccctctgctcccaaccctgtggtgctaggaccactccccgccttccctacggcctcctcgccctgcacattccccacctccacattcccctcctccaagatctcagctccttaacatatcagttgtctcctagcctagaaaaccagtgtttggagcaataagatgattatttttgcttgaatctttttctaagagaaggaaaagagctggcattgtgggaattttctttttatgctgttagctgtttaccttcttagaagacatcctaataggatggatgtctgggttttagccttggggtatcttttggaaacttagaaaagcaggagtcaggctgccaccccctaaggagggaccctaacgttctgcccttgcctggttccatatggctccttccagccctgcccaccaagtgcagctcccactttccatcctgcccatacgcccctcttcccccgacatctgggggcgctggtggcacttactctaggttggtctcagactatccctccccttggctggttttccctcctaggcctgtctggcagcccccagacagacgtagctcctgggagtctcggccctggcaaccttggaagagccaagctgacattgtttagctcttcaggccactgggttttggaggcagaagtccagagatactggctctgccaagctgtcgtactgggctgtggcacagccttcgagacaacacgggtgtatctctgatcctgccctacctaggcttcaaggggcttctgtctggagaaatgccctcaaagggtaaccagtaggtgtggcattgaattggccagtgttagcatctacagccatcaccgagatgagtccactgccgttgcctgcccgagggccccctaaggttatagacggtatcagcagggaggccgtcccgctggttttctaggagagcccacaggaggaagggagcctcttcaggggcactggaatcttttgtgccaggggcttcttttcatcagagccggggagtacattgcagtgacttcttaaacatttgtgtgggacagacgagcgtgagggaggttttaagccaggcacaaagttagtttccaatactagttaataaatctatttttcttcatttcctttttttgcacagaagctggtaatctaggacctacgtgtgaacaactttatatgaatattttttgtacttggtttacttgggttggtatgatacattatatttaagttccttgaacactgtggatcccctaatgtgtatgaatgactgaggctttgtaaattaagggacgtttgtgtgaataaagttatttgatggggtcaaagaagccatatgtgatttgaaaaa

SEQ ID NO: 180361 - DNA, 1595 bp, Homo sapiens
  Payload ID: 15523
  Gene Symbol: STK35
  Gene Name: serine/threonine kinase 35
  ENST ID: ENST00000493263
  CDS Start-End: 1-1188
ggcgcccgcagaggtacacaaagcccggagcggaaaaggcgaagcccagtgccgcgggcgcccagcacgaagctgaggccggcggcggcggcccgggccatggatccggtggcggccgaggccccgggcgaggccttcctggcgcggcgacggcctgagggcggtggcgggtccgcgcggccgcgttacagcctgttggcggagatcgggcgcggcagctacggcgtggtttatgaggcagtggccgggcgcagcggggcccgggtggcggtcaagaagatccgctgcgacgcccccgagaacgtggagctggcgctggctgaattctgggccctcaccagcctcaagcggcgccaccagaacgtcgtgcagtttgaggagtgcgtcctgcagcgcaatgggttagcccagcgcatgagtcacggcaacaagagctcgcagctttacctgcgcctggtggagacctcgctgaaaggagaaaggatcctgggttatgctgaggagccctgctatctctggtttgtcatggagttctgtgaaggtggagacctgaatcagtatgtcctgtcccggaggccagacccagccaccaacaaaagtttcatgctacagctgacgagcgccattgccttcctgcacaaaaaccatattgtgcacagggacctgaagccagacaacatcctcatcacagagcggtctggcacccccatcctcaaagtggccgactttggactaagcaaggtctgtgctgggctggcaccccgaggcaaagagggcaatcaagacaacaaaaatgtgaatgtgaataagtactggctgtcctcagcctgcggttcggacttctacatggctcctgaagtctgggagggacactacacagccaaggcggacatctttgccctgggcattatcatctgggcaatgatagaaagaatcacttttattgactctgagaccaagaaggagctcctggggacctacattaaacaggggactgagatcgtccctgttggtgaggcgctgctagaaaacccaaagatggagttgcacatcccccaaaaacgcaggacttccatgtctgaggggatcaagcagctcttgaaagatatgttagctgctaacccacaggaccggcctgatgcctttgaacttgaaaccagaatggaccaggtcacatgtgctgcttaaaattcagggctaagcattttgggtgattttaaactagcagtgaccagaggtgctgttggacttcatggagctcatggcctcgagtgacatgtgtgggagtggacatttggacacagaggaggcatcaccccagtcctaggcaagggtctgctcccatctgtcatgggaaggaggtcagatgagaccacagctaactttccttctggctccaacactctgtgttccaggattctccagaatggaacagtctgaccttggggattctagcaggatcaagtcaggtccccttcatcatcccctctctccctctcatgccccgggaggcttccactcctgcagcatcaggcactgggaggcagagtccagctccacagtcatttttaacatattaaagttctggacagaaa

SEQ ID NO: 180362 - DNA, 4933 bp, Homo sapiens
  Payload ID: 15524
  Gene Symbol: STK36
  Gene Name: serine/threonine kinase 36
  Uniprot ID: Q9NRP7
  ENST ID: ENST00000295709
  CDS Start-End: 280-4227
aaaactaagaggggtgggcagctagcgtcgtttctaggcaaccgcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaa

SEQ ID NO: 180363 - DNA, 4821 bp, Homo sapiens
  Payload ID: 15524
  Gene Symbol: STK36
  Gene Name: serine/threonine kinase 36
  Uniprot ID: Q9NRP7
  ENST ID: ENST00000392105
  CDS Start-End: 237-4121
gcagactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttc

SEQ ID NO: 180364 - DNA, 4721 bp, Homo sapiens
  Payload ID: 15524
  Gene Symbol: STK36
  Gene Name: serine/threonine kinase 36
  Uniprot ID: Q9NRP7
  ENST ID: ENST00000440309
  CDS Start-End: 160-4107
agaagagatggggctaaacgccagggaatccgtcccttggcctgaggagcttggagctcctaggctgggggcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctacccccagaacttcaggtcctaaaggacgaacaggcccatcggttggcccccaagggtaatcagtctcgcatcttgactcaggcctataaacgcatggctgaggaggccatgcagaagaaacatcagaacacaggacctgcccttgagcaagaggacaagaccagcaaggtggctcctggcacagcccctctgcccagactcggggccactcctcaggaatcaagcctcctggccgggatcttagcctcagaattgaagagcagctgggctaaatcagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatcttggtatgggaccttcttacaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctgagcagactttgcggagggacagccttatgtgctttactgtcctgtgcgaagccatggatgggaacagccgggccatctccaaagccttttactccagcttgctgacgacacagcaggttgtcttggatgggctccttcatggcttgacagttccacagctccctgtccacactccccaaggagccccgcaagtgagccagccactgcgagagcagagtgaggatatacctggagccatttcctctgccctggcagccatatgcactgctcctgtgggactgcccgactgctgggatgccaaggagcaggtctgttggcatttggcaaatcagctaactgaagacagcagccagctcaggccatccctcatctctggcctgcagcatcccatcctgtgcctgcaccttctcaaggttctatactcctgctgccttgtcagtgagggcctgtgccgtcttctggggcaggagcccctggccttggaatccctgtttatgttgattcagggcaaggtaaaagtagtagattgggaagagtctactgaagtgacactctacttcctctcccttcttgtctttcggctccaaaacctgccttgtggaatggagaagctaggcagtgacgttgctactctctttacccattcgcatgtcgtctctcttgtgagtgcagcagcctgtctattgggacagcttggtcagcaaggggtgacctttgacctccagcccatggaatggatggctgcagccacacatgccttgtctgcccctgcagaggttcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcgcctcatgggtctgagtttctccctgtcgtggtgctctctgtctgccagctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcacc

SEQ ID NO: 180365 - DNA, 583 bp, Homo sapiens
  Payload ID: 15524
  Gene Symbol: STK36
  Gene Name: serine/threonine kinase 36
  ENST ID: ENST00000455724
  CDS Start-End: 357-583
agactccgggtccttagccgggcctgatggccctgaggcagttcggatgtgtcccaggaagtgcccatgtgtggtccgccgtccattccacacctctgagcgcctttgtcctctgaacttctcaccagttctagcgagtaaaattgcgtcccagatgttgtggaactgtccctggatctatagctcttcaccgtctctactttcttccttctaagagatcctgaaacctctgtcatggaaaagtaccacgtgttggagatgattggagaaggctcttttgggagggtgtacaagggtcgaagaaaatacagtgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaa

SEQ ID NO: 180366 - DNA, 878 bp, Homo sapiens
  Payload ID: 15524
  Gene Symbol: STK36
  Gene Name: serine/threonine kinase 36
  ENST ID: ENST00000424080
  CDS Start-End: 43-878
agcttggagctcctaggctggggagatcctgaaacctctgtcatggaaaagtaccacgtgttggagatgattggagaaggctcttttgggagggtgtacaagggtcgaagaaaatacagtgctcaggtcgtggccctgaagttcatcccaaaattggggcgctcagagaaggagctgaggaatttgcaacgagagattgaaataatgcggggtctgcggcatcccaacattgtgcatatgcttgacagctttgaaactgataaagaggtggtggtggtgacagactatgctgagggagagctctttcagatcctagaagatgacggaaaacttcctgaagaccaggttcaggccattgctgcccagttggtgtcagccctgtactatctgcattcccaccgcatcctacaccgagatatgaagcctcagaacatcctcctcgccaagggtggtggcatcaagctctgtgactttggatttgcccgggctatgagcaccaatacaatggtgctgacatccatcaaaggcacaccactctatatgtctccagagctggtggaggagcgaccatacgaccacacagcggacctctggtctgttggctgcatactatatgaactggcagtaggcacccctcccttctatgctacaagcatctttcagctggtcagcctcattctcaaggaccctgtgcgctggccctcaaccatcagtccctgctttaagaacttcctgcagggactgctcaccaaagacccacggcagcgactgtcctggccagacctcttatatcacccctttattgctggtcatgtcaccataataactgagccagcaggcccagatttggggaccccattcaccagccgcctaccccc

SEQ ID NO: 180367 - DNA, 2093 bp, Homo sapiens
  Payload ID: 15524
  Gene Symbol: STK36
  Gene Name: serine/threonine kinase 36
  ENST ID: ENST00000419433
  CDS Start-End: 1-445
tcggttgactccaccaggtagttgtggattctatgatggcctccttatccttctgttgcagctcctcactgagcaggggaaggctagcctaatcagggatatgtccagttcagaaatgtggaccgttttgtggcaccgcttctccatggtcctgaggctccccgaggaggcatctgcacaggaaggggagctttcgctatccagtccaccaagccctgagccagactggacactgatttctccccagggcatggcagccctgctgagcctggccatggccacctttacccaggagccccagttatgcctgagctgcctgtcccagcatggaagtatcctcatgtccatcctgaagcatctgctttgccccagcttcctgaatcaactgcgccaggcctcctttgcttcccctttgcgctggacatggatgctgacctccttataggtgtcttggccgacctcagggactcagaagttgcagcccatctgctgcaggtctgctgctaccatcttccgttgatgcaagtggagctgcccatcagccttctcacacgcctggccctcatggatcccacctctctcaaccagtttgtgaacacagtgtctgcctcccctagaaccatcgtctcgtttctctcagttgccctcctgagtgaccagccactgttgacctccgaccttctctctctgctggcccatactgccagggtcctgtctcccagccacttgtcctttatccaagagcttctggctggctctgatgaatcctatcggcccctgcgcagcctcctgggccacccagagaattctgtgcgggcacacacttataggctcctgggacacttgctccaacacagcatggccctgcgtggggcactgcagagccagtctggactgctcagccttctgctgcttgggcttggagacaaggatcctgttgtgcggtgcagtgccagctttgctgtgggcaatgcagcctaccaggctggtcctctgggacctgccctggcagctgcagtgcccagtatgacccagctgcttggagatcctcaggctggtatccggcgcaatgttgcatcagctctgggcaacttgggacctgaaggtttgggagaggagctgttacagtgcgaagtaccccagcggctcctagaaatggcatgtggagacccccagccaaatgtgaaggaggctgccctcattgccctccggagcctgcaacaggagcctggcatccatcaggtactggtgtccctgggtgccagtgagaaactatccttgctctctctggggaatcagtcactgccacacagcagtcctaggcctgcctctgccaaacactgcaggaaactcattcacctcctgaggccagcccatagcatgtgattccagattcctgcggtccagcctccaactttggttgccagctctttcttattctactacacaagccgccaactcaactgagagctaaagagactagaaaagagataagctgccaactcaactgagaacaagaaactagaagagatttatatataaagcttcttccttctcccagatgcaggatgttttcaaccagtaaattttattgctgttggtgccagagaagagtcctttcttctctacatccaggggccttttctccaataatgtgcctttaactctagggacctgcctcacggaccttagggaaaaacctcaacctgaaagatctcttcctttctggagctcctttaatcttcccagcaggtttttgccttagacgtgctggccccaggacagtgatgaagacagagcctgtctcagctctaggctgtggggatcaatgccatcagtccctgttattgagggattatcccttagccaacattcctatctgtgggtgggcgtggagagtgtatctttttttggggtgtgtgtgtatatgtgtgtgtgtatgtgtgtgtgtgtttaatagttctgtttgtaaactcttttaataaaagttgtgcctcaccatacttgaagctcccaggacaagggttgagaggctcaacccctctttcagcttctatgtggtgttggaggtgctggtatcgtgttcacacaag

SEQ ID NO: 180368 - DNA, 563 bp, Homo sapiens
  Payload ID: 15524
  Gene Symbol: STK36
  Gene Name: serine/threonine kinase 36
  ENST ID: ENST00000414413
  CDS Start-End: 1-320
cagggactggagaggtgccctctgcacctcgggaaaaccggaccaccccagattgtgaacgagcattcccagaggagaggccagaggtgctgggccagcggagcactgatgtagtggacctggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcaggtgaagggctggagaagggagggagcagatgggaatggcacttagtctgacagagatcctgaggagaggcccctatccgttggtcactggtgttctgtgttagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcagcaatc

SEQ ID NO: 180369 - DNA, 586 bp, Homo sapiens
  Payload ID: 15524
  Gene Symbol: STK36
  Gene Name: serine/threonine kinase 36
  ENST ID: ENST00000422778
  CDS Start-End: 1-199
ggaaaatgaggagccagacagtgacaatgagtggcagcacctgctagagaccactgagcctgtgcctattcaactgaaggctcctctcaccttgctgtgtaatcctgacttctgccagcgcatccagagtcagctgcatgaagctggagggcaggtgaagggctggagaagggagggagcagatgggaatggcacttagtctgacagagatcctgaggagaggcccctatccgttggtcactggtgttctgtgttagatcctgaaaggcatcttggagggtgcttcccacatcctgcctgcattccgggtcctgagcagtcttctctccagctgcagtgattctgttgccttgtattccttctgccgggaggcagggcttcctgggctgctgctgagtctactcaggcacagtcaggagagcaacagcctccagcaggacctgatggctgtgattcaggcctactttgcctgtaccttcaatctggagaggagccagacaagtgacagcctgcaggtgtttcaggaggctgccaacctttttctggacctgttggggaaactgctggcccaaccagatgactctga

SEQ ID NO: 180370 - DNA, 3576 bp, Homo sapiens
  Payload ID: 15525
  Gene Symbol: STK38
  Gene Name: serine/threonine kinase 38
  Uniprot ID: Q15208
  ENST ID: ENST00000229812
  CDS Start-End: 287-1684
ctcggccccgggctgccgcgccagcccgtctccgcggcgggggaccgggctgccttggcccctcagcgctcgcgtcttttccggcagttggaacgcttcctgttgtcctcacccgtaaccgcctgttgccccctgtctcagagtccctcacgcgtcccctcccgtctttggctcgttggctgccgccgccggggcttcgccagccttcaagtcgagactactggccgaaggggcgtctgcggctctccgccgtccccagccctgcctctccctgggctctgcagccatggcaatgacaggctcaacaccttgctcatccatgagtaaccacacaaaggaaagggtgacaatgaccaaagtgacactggagaatttttatagcaaccttatcgctcaacatgaagaacgagaaatgagacaaaagaagttagaaaaggtgatggaagaagaaggcctaaaagatgaggagaaacgactccggagatcagcacatgctcggaaggaaacagagtttcttcgtttgaagagaacaagacttggattggaagattttgagtccttaaaagtaataggcagaggagcatttggtgaggtacggcttgttcagaagaaagatacgggacatgtgtatgcaatgaaaatactccgtaaagcagatatgcttgaaaaagagcaggttggccacattcgtgcggagcgtgacattctagtggaggcagacagtttgtgggttgtgaaaatgttctatagttttcaggataagctaaacctctacctaatcatggagttcctgcctggaggggacatgatgaccttgttgatgaaaaaagacactctgacagaagaggagactcagttttatatagcagaaacagtattagccatagactctattcaccaacttggattcatccacagagacatcaaaccagacaaccttcttttggacagcaagggccatgtgaaactttctgactttggtctttgcacaggactgaaaaaagcacataggacagaattttataggaatctgaaccacagcctccccagtgatttcactttccagaacatgaattccaaaaggaaagcagaaacctggaaaagaaatagacgtcagctagccttctccacagtaggcactcctgactacattgctcctgaggtgttcatgcagaccgggtacaacaagctctgtgattggtggtcgcttggggtgatcatgtatgagatgctcatcggctacccacctttctgttctgagacccctcaagagacatataagaaggtgatgaactggaaagaaactttgacttttcctccagaagttcccatctctgagaaagccaaggatctaattttgaggttctgctgtgaatgggaacatagaattggagctcctggagttgaggaaataaaaagtaactctttttttgaaggcgttgactgggaacatatcagagagagacctgctgcaatatctattgaaatcaaaagcattgatgatacctcaaacttcgatgagtttccagaatctgatattcttaagccaacagtggccacaagtaatcatcctgagactgactacaagaacaaagactgggtcttcatcaattacacgtacaagcgctttgagggcctgactgcaaggggggcaataccttcctacatgaaagcagcaaaatagtactcttgccacggaatcctatgtggagcagagttctttgtataacatcatgcttttcctctcacactcttgaagagcttccaagaagttgatggaacccaccaatatgtcatagtaaagtctcctgaaatgtggtagtaagaggattttcttccataatgcatctgaaaaactgtaaacaaagacaaccatttctactacgtcggccataaacagctatcctgctttggaagagaagcatcatgagccaatttgataggtgttttaaaaataacttgagttttcctaagttcatcagaatgaaggggaaaaacagccatcatccaacattattgagattgtcgtgtatagtcatcgaatatcagccagttcctgtaattttgtgacacgctctctgccaagcccaccaagtatttcctttatagctaaaagttccatagtactaaggaaataaagcaataaagacagtctcagcagccaggattctggctgaaggaaatgatccgccaccctgagggtggtgatggtagtttctacccatacctcagcctcaggcgagtggcttatagcctccattcatggtgcactttatttatggtactaagataaagactgtcaatccattgatttatctcctcctgtcccccatctaaaatacccatgctgcttttctgagtgttgatgggggttaccagcttgatccactgttgctcttagaaggcccagaaagtctttgggcattgccaagaaatcccggattatgtggaaaaccctcactttctcttcacggctgtaccagaaaatccctaagacagatcttgccgtggactagcaatacctgcaagtgctgccaatgggaactcaatttattcctgggaacctaacgaggagagcccaggcctaggcaggaggcctggaaccctcttggctaaggtgctgttcctgttcctgcaaggtctccagaacccctttggaaatggtgaaggaaccagcccaatagaagtacagagccagctgacaagtccttgtaaagctcactcctcagtccttggcacagccatgttttgtcttctctcttggtatttcttctctcccaactttagccattttgccttggaatcatgattacaattttttcctttgcagatgccttcctgggggatactcctccccaccctaaagggtcgcctgcaacttaggcggattgggtctctctgctgtggcgttctctcttgagagaccctctgaattttagcacaaagtgccttctgtttcacagctgccaccacctttagaggaatttcgtcagaaaaatgtggaggctccatattaatgcattattttttaaaaagttttgataactcttaaagcatcatttgcacctatgtgggaactttgcctgttgcaaagtattgtggccgagctgcagctgggagcctgctttctgccagtcttgaggttctgaagatcagctttgaaaggaaagtatgtcctagcttagccattcagaagagaaaaatggaatatcagagttacagttgtcagtgaaactactttggattttaacctcttagaggaagaaaaaaggttagggaagtgtcaactctggatgaaggtgatgtgtttgcctctcagtctttcattcatagcctgctagtgaaaaggaagtaaatgagattcttttgtgtgactttgtagtctctttgtattaccaaatagttggggtgttgactcctgtgtgttttgcaagaatgtgtggtaagcctgggtaaagagaaggaactgcggtgttgggagagtctttgtgttggggagtggcaggggatgatttgtttcaggggaaaatgcccacattttaacttttaaacttctgaataaactgtgtaaaaaca

SEQ ID NO: 180371 - DNA, 5068 bp, Homo sapiens
  Payload ID: 15526
  Gene Symbol: STK38L
  Gene Name: serine/threonine kinase 38 like
  Uniprot ID: Q9Y2H1
  ENST ID: ENST00000389032
  CDS Start-End: 170-1564
gagagttcagggaggccgccctgagattccggcgaggccgcgggtcccacctcccgggggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacattgccctattggtttggacatctgtagaatatatatgaagacaatttctgtaatggttttaagagatttaaaaagaaattcactggttctttacaaaatagaatttatcatcaagttattacacaaacttcacagtaaggagtgacaagtttataataaggaagacaaagtttaacaccttcactcaagcactccactaatatatttacgttgcattcagaaatactgatgaccttcatatacgtagtctgtatactcatagggagatgtactgtattatataacatgtaaagttgattttcttgtgacaagagaacttctttttttaacaagaggacatggcattattttaatttgattatggtgagttgaatttaagacatgaccatgaaggctgcttgtagaattagtgtatttttattaaactatttttttaaatgtcaaacttctatcatgtaaatggacttatagagaacaaaaagctatttactttggttttctagaaagttgttacatatcatggctggttaacttttatttcttttgatgaaaatttttcctttgatagtacttgtattattgtgccattattttcttatgctccaaatgtaccaaagatcttgaacagagtggatgttcacaactgagtagaattttcctttcctgtgggcatgctgtattcagacctgacagatctttgatagaggtcagcttattaaagggcaatattgttcttgtttagctacatcactgtggtgaatatagatggaattaaggaagtaaatgcaggccagggggttgtgatgagaggataggggagataatatcagcatcaaattctttgggtatctctctaagaattaaataatcttttctagcttaatattttaattctaattcaaacaactctgaggttttggtttcattagtaatagttgaggaataatatactagcaaagaatggcctaatgtttgtcataactgttaatggatgaaattttttaaagatacaaccatgataaccattataaatgatctatgatcaaaatctaaagtgatgaattatttgtaggaatgtcttcctaatggggaagaattgcataggagcattatgcaaatctacacaagcttttataaatgttgctgctgggtagctccacagtgtttcataaggccatcctgtttcccccaactcccccatttttggtttgtttctttttaaatatttgttgagtacttacgtgtttatctaacagttcacttccatttttctagtctggattttttgagtatttaggaaagagagctattaaaaactggggatttctcaatgtgactaactctaatttttctaattataactgcctttaattaacataatattaacttttgctgaggtttatgagattttctcaccccacatcgctcccctttttttaaaaaggactgttttgctagtgtgataatgaataggtaagatatgagataattgcaacattgtctagttctagtatggtaactattcttgaaatggtattgaaaaataccgttaattcaaattgacagagattgataaaaagaaactgatttacctaagtttactttttaattgcataatagagcattttttgttttgagttccctcattcttattaccagaaagagcttgcaaatagttttactttcttggcactggaagggtagttctggaaagctactttgttgagagtctcattcttccctggagttaatagagtgattcacaatctttggggttttctcctcatcaaaagcatttcttaagtgcctatctaaaagcaattaaagactgtgtctgccctttagaagctaagaatttgattcatgatgcaaattaactagataatttgcaaagtacccttgagattgaattttctctattatatatttcccatatttcaggtgaataatttaatttaaatgacaaaaccctatctagtcaactgggcataatgacattttctttaaattagactctattttgaattaaaagagttttattataaaccgtgtgtttttggtttttctaagtatatagaaagcttgtataattcagatttatcaatttcctgatttaatgtagactttgacttttttattaaaaacctttgtattaaagcaagttatgttatttttcttttatgcatttattactaacatagctttaaatctttaaatgtattgaagcattgtgctgtctgaaaataaggaattgcttataaaccagccacttctgaatacaatatgtagctgatttaataagctagttagtgaatggaaaataagtgtggagtattaaaaatgttctttggttggtaaggcctaagatagggtttcatttatttctatactttttctgttttttaaacacctgcatatttttatgtaaatctctaaatttaaaatattttaagtacatttatttttggtgttttattgtataaaaccttagacaatcaatcagtcagtctttactgacaggagcagcagctatctgtcttttgctgatctacaaataaatgaattgagaatttagtccatagaggtccctggctaccaaacacattctcctttgaattgttaaaattcagaacattcaaaataactgttttgctacaacccatgattattttcctgttgtgtttatttaaatttactttctctttagaagtgcacttatttctgaaaaatcttaatgaaacaaacgcttagaacaaatataaatatgagacacttgggactactagagatattttagatttttatgaaaaaaatgtgaggggatattgctgctttaaaaaggaataaagtaataaaaatatatctcagctatttttttaaagcaatataattcagcaattgtctagaaaagtaatcatgaggctactgagtttggtgttcagttactgagtttcaaaaatgttttggtggcatgaggacaaaatttcattgaaggtaagataagaataaaaactatgtttacaaaa

SEQ ID NO: 180372 - DNA, 580 bp, Homo sapiens
  Payload ID: 15526
  Gene Symbol: STK38L
  Gene Name: serine/threonine kinase 38 like
  ENST ID: ENST00000407753
  CDS Start-End: 1-269
ggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctcatttcagaacatgaactcaaagaggaaagcagaaacttggaagaagaacaggagacaactg

SEQ ID NO: 180373 - DNA, 545 bp, Homo sapiens
  Payload ID: 15526
  Gene Symbol: STK38L
  Gene Name: serine/threonine kinase 38 like
  ENST ID: ENST00000541191
  CDS Start-End: 153-545
acggcagtgaggtgaggctggtgagaggggaagtggcgacagttcagtcaactccctcaaaaccagtctggccttcaccaggcggagatgggtggggccgggaagacgggcgttgacgacagaaggctacttccggctgtgtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 180374 - DNA, 752 bp, Homo sapiens
  Payload ID: 15526
  Gene Symbol: STK38L
  Gene Name: serine/threonine kinase 38 like
  ENST ID: ENST00000545470
  CDS Start-End: 112-752
ggcggggcgagggcggagcggggagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttctccctggaggtgacatgatgacattgctaatgaagaaagacaccttgacagaagaggaaacacagttctacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccacc

SEQ ID NO: 180375 - DNA, 526 bp, Homo sapiens
  Payload ID: 15526
  Gene Symbol: STK38L
  Gene Name: serine/threonine kinase 38 like
  ENST ID: ENST00000544969
  CDS Start-End: 134-526
agggcagcctgctcgacaaggccccttggcagacagtcagctccctccaaggccaaaccccaagttcaacatacatctttctctcccatttctgcaagcataactgtgaacagcataattcttttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 180376 - DNA, 548 bp, Homo sapiens
  Payload ID: 15526
  Gene Symbol: STK38L
  Gene Name: serine/threonine kinase 38 like
  ENST ID: ENST00000543246
  CDS Start-End: 156-548
attgtatgtgaattagccacccttgtgactatttgaggagagagaagttagtctaaaatattatgttaaattatgatattacataattttattgcataagttcatcaaactacttccatctgaaaaatcctgatctcaaaatagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 180377 - DNA, 477 bp, Homo sapiens
  Payload ID: 15526
  Gene Symbol: STK38L
  Gene Name: serine/threonine kinase 38 like
  ENST ID: ENST00000546286
  CDS Start-End: 37-207
cggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccagaggagaaaactggaaatcattcaacaagcagcactgaagtgcctaggggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcag

SEQ ID NO: 180378 - DNA, 463 bp, Homo sapiens
  Payload ID: 15526
  Gene Symbol: STK38L
  Gene Name: serine/threonine kinase 38 like
  ENST ID: ENST00000540996
  CDS Start-End: 181-463
gtgcggaggctgagccggccgcgggcgcgaccggaggcaggcatctgaatttcatttgaaaatgaaatgggctgcacagtctggagaagtgtactataccttgttatagcacgttttggaatgacccagaattcagaatgaaatgggcagctatgagccccatccaaagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagagaaaaagttacgtcgatcacaacacgctcgcaaagaaacagagttcttacggctcaaaaggaccagacttggcttggatgactttgagtctctgaaag

SEQ ID NO: 180379 - DNA, 1369 bp, Homo sapiens
  Payload ID: 15526
  Gene Symbol: STK38L
  Gene Name: serine/threonine kinase 38 like
  ENST ID: ENST00000536093
  CDS Start-End: 1-264
tacatttcagagactgttctggcaatagatgcgatccaccagttgggtttcatccatcgggatattaagccagacaaccttttattggatgccaagggtcatgtaaaattatctgattttggtttatgtacgggattaaagaaagctcacaggactgaattttatagaaatctcacacacaacccaccaagtgacttctatgtatatgtattttctttttgtggagagcatttttccctcgtgattacaattccatattgttgaaattagcatttcagaacatgaactcaaagaggaaagcagaaacttggaagaagaacaggagacaactggcatattccacagttgggacaccagattacattgctccagaagtattcatgcagactggttacaacaaattgtgtgactggtggtctttgggagtgattatgtatgaaatgctaataggatatccacctttctgctctgaaacacctcaagaaacgtacagaaaagtgatgaactggaaagaaactctggtatttcctccagaggtacctatatctgagaaagccaaggacttaattctcagattttgtattgattctgaaaacagaattggaaatagtggagtagaagaaataaaaggtcatcccttttttgaaggtgtcgactgggagcacataagggaaaggccagcagcaatccctatagaaatcaaaagcattgatgatacttcaaattttgatgacttccctgaatctgatattttacaaccagtgccaaataccacagaaccggactacaaatccaaagactgggtttttctcaattatacctataaaaggtttgaagggttgactcaacgtggctctatccccacctacatgaaagctgggaagttatgaatgaagataacattcacccataaccaagagaactcaggtagctgcatcaccaggcttgcttggcgtagataacaatacactgaaatactcctgaagatggtggtgcttattgactacaagaggaaattctacaggattaggatttctaagactactataggaattggttggcagtgccagctggctcttttttttaatattttattatttttgttaactttattatatgaaggtactggaataaaaggaacagacatccctttctaactgcactgcctacatgcgtattaaggtccattctgcctgtgtgtgctgtggctttgaactgtaacacctctaatcaattcaggagaaacacatatcatttaaagcaacataggctaacctgtaggtaacactgcagtattgatgttttactgcaaatcttatgggtctagataatcagtaaaagccatcttccatagttggtgttagaacat

SEQ ID NO: 180380 - DNA, 664 bp, Homo sapiens
  Payload ID: 15526
  Gene Symbol: STK38L
  Gene Name: serine/threonine kinase 38 like
  ENST ID: ENST00000544367
  CDS Start-End: 90-284
gagaagggagctgacgggcgcccggccggctgcggtccgtgcggaggctgagccggccgcgggcgcgaccggaggcagtttccgttactatggcaatgacggcagggactacaacaacctttcctatgagcaaccatacccgggaaagagtgactgtagccaagctcacattggagaatttttatagcaacctaattttacagcatgaagagagagaaaccaggcagaagaaattagaagtggccatggaagaagaaggattagcagatgaagaggtaatgtaattacctataattactgtacaaaagcacccccagtgacttttcattcatttgacatcagaaaaagttacgtcgatcacaacacgctcgcaaagaaacagagttcttacggctcaaaaggaccagacttggcttggatgactttgagtctctgaaagttataggaagaggagcttttggagaggtgcggttggtccagaagaaagatacaggccatatctatgcaatgaagatattgagaaagtctgatatgcttgaaaaagagcaggtggcccatatccgagcagaaagagatattttggtagaagcagatggtgcctgggtggtgaagatgttttacagttttcaggataagaggaatctttatctaatcatggaatttc

SEQ ID NO: 180381 - DNA, 2038 bp, Homo sapiens
  Payload ID: 15527
  Gene Symbol: STK4
  Gene Name: serine/threonine kinase 4
  Uniprot ID: Q13043
  ENST ID: ENST00000372801
  CDS Start-End: 48-1436
cgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttaaaactagccaagaacagcagtctggaaaagacatatgtatccaaaattgccagggaaacctgctgtgtagatacgctttctgagaaaccacatgcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggta

SEQ ID NO: 180382 - DNA, 6342 bp, Homo sapiens
  Payload ID: 15527
  Gene Symbol: STK4
  Gene Name: serine/threonine kinase 4
  Uniprot ID: Q13043
  ENST ID: ENST00000372806
  CDS Start-End: 96-1559
ggaaagcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggaccacaaaccctta

SEQ ID NO: 180383 - DNA, 6161 bp, Homo sapiens
  Payload ID: 15527
  Gene Symbol: STK4
  Gene Name: serine/threonine kinase 4
  ENST ID: ENST00000499879
  CDS Start-End: 91-1389
gcggaagtgtgggagggtctgcggggcgggctcaggaggtccgcgggaggatggagcagtgagcgggtctgggcggctgctggcagcgccatggagacggtacagctgaggaacccgccgcgccggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacggataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagggcaatcttcatgattcctacaaatcctcctcccacattccgaaaaccagagctatggtcagataactttacagattttgtgaaacagtgtcttgtaaagagccctgagcagagggccacagccactcagctcctgcagcacccatttgtcaggagtgccaaaggagtgtcaatactgcgagacttaattaatgaagccatggatgtgaaactgaaacgccaggaatcccagcagcgggaagtggaccaggacgatgaagaaaactcagaagaggatgaaatggattctggcacgatggttcgagcagtgggtgatgagatgggcactgtccgagtagccagcaccatgactgatggagccaatactatgattgagcacgatgacacgttgccatcacaactgggcaccatggtgatcaatgcagaggatgaggaagaggaaggaactatgaaaagaagggatgagaccatgcagcctgcgaaaccatcctttcttgaatattttgaacaaaaagaaaaggaaaaccagatcaacagctttggcaagagtgtacctggtccactgaaaaattcttcagattggaaaataccacaggatggagactacgagtttcttaagagttggacagtggaggaccttcagaagaggctcttggccctggaccccatgatggagcaggagattgaagagatccggcagaagtaccagtccaagcggcagcccatcctggatgccatagaggctaagaagagacggcaacaaaacttctgagcaaggccaggctgtgagggccccagctccacccaggctttgggtgaattctggatggcttgcctcatgtttgttagccagcacttctgctctgtcgtctctccacagcacctttgtgaactcaggaatgtgcgccagtgggaagggctctcttgacagtcagcgtgccatcttgatgtgtgtatgtacattggtcaggtatattatctcaaaggatttatattggcgcttttaactcagagttttaaaccccaggaacagagactcctagttgagtgatagctgggaaagttttacattgtctgtttttcttctcccaatagctttcaattgttctttctggaagacttttaaaaaaatataaatatgcatatatatatataaattataaatagattccccacgcagtgtggtggcatctctgtacaggtacagttttaaacggtttgcctcttttctgtaagattatggtactgtggaacatgagggcagaggacaccgggaggctgttagggggtcactgaatcccaggagccaacctccccctttgcagggctgcatttaaaaattaggtttgggacagttcttgtaccgtggtttcagccttgtgtggtcatcactggcttctggagctattggtgatgtccaagggaaagctttgagagtttatgtttactctttgagtcccaggagaagcctggcaccctctttgcaaattggcctttgctctttcaatgcctttcatccatctccactctctcaactgcctaaagtcacagcacagatactgcccagtgccttaagaggagacatgatctctaccagggactctcagcaaacacgggactgtgttcagtccacaaaggaaaagcgtttttgaagctctcattgttcatgtaaaaatcatacacgtggcatgttgctccacattccttacacacaggggtagaggggattgcttttgtgacccacgttcaaatatgtgactgttttcttttctcttttactgctaagcagcctggaaaggataaatgaatattagactaagatttgttttccaggaggctcaatctgaacacacagaatgtcagagctggaagggactatagagatcatctgatctgatcctcttgtacggatgatcgcaaaactgaggtgtagagaggggaatggccaaaatcacaaagcaagttagcgttaagagctgagactagaattcagggtcctcactcccaggccaccgaaccatgcagccccttctttgggggaagagacctgtgtcagtcttggttaattgttccagggaaccttgctaacagaaacttgctcttgccttggctcttcagtagatgacctggctgtaaagagattccctggacgagccagatcattcagtttcagcgagtccttgagctccacaacatctaccagatatagcagacaagcacccatggaggcaggtttcgggcctgaagcagatcagagggctttgcaaaagacagcatagagccatcttcctgcaactttacctctttccctcagatggggagccatgactgggttgcacctcaggatactgtaatttgactccataattgcttttgctcctgaaacctgggaatcaatggaaaggcagggaatgtgcctcttctgtggccagattctgttatttgcaattaaagcaagtttttaaaaaatgcaagaggcagttgttagtcttcagggcttggcaactgaaatagctatgtggcggatacggaaaacagaggacaatttgaggatcttgctggaataataaatgacagctaccatttgttgagcacctattatatatcaggcactgagctgggtaggctctaaacttcacaataaccctgtgacttaactactttatctccattttgtagttgaagaaataagttcagagagaaagattccttcccaaggtcatgcagctagtaaatgatagaatcaggattcatagcatcactatagggggtcaatatttacacaaaaaaggaaagtcacaagcctgtttaaaatgaagtgaccaccttttcttgcatagactaaataactcgaactggcatttttaggttggaaagacagctgaattagtagttaagtctgatagccaagtaagttttaaaaaccaaagcatccaggatgcacacccctgcaccatttgctgtgcgaattaatagttctgtctctctctctctttcttttttctttttattctttgagatggattttcgctcttgtcgcccaggctggagtacaatggcacgatcttggctcactgcaacctccgcctcccgggttcaagcgattcttctgctgggattacagcatatgccaccatgcccagattatttttttgtatttgtagtagagacggggtttcaccatgtcagtcaggctggtcttgaactcctgacctcaggtgatccacccgcctcagcctcccacactgctgggattacaggcatgagccaccgctcctggcctctctttcttttttaaacaaagaactttgcacttggccagagaggaggagaaagcccattttctcccttcctaagctagatccaaataaaagaaagttcagttttcccccataactattcttgggtcatgaactttgatctggagtttgttttgtttcaggaatgtgtgcacccagcttgctgatccaacaaagtctattgcttaccagtctagcttgatgaagccttttggccagaagtcaatttgttttggatcagagaaatttcctgacaaggtatatttgttttctagtgacagaaaggcaaaggaacaagtcctagttgttgttgttgttgttgaatactaaatttaagatatgtcagcttgctttcaatgagccttgggcttctgttattgcttgagcatttggaactcgagcttccagagaaatttgaggtcctcgcttgttctctgccttcaagaaacaatgacctgattctgtctttaaaaaaaaaaatctcagaattctttttttgtttgtgtttttttttttttttgagacagagtctcactctgttgcccaggctggagtgcagtggcgccatctcggctcactgcaacctccgcctcccaggttcaagcaattctcctgcctcagcctcccaggtagctgccactacaggtgctgcaccaccacgcccggctaatttttgtatttttagtagagacagggtttcaccatattagccaggtgggtcttgaactcctgaccttgtgatccacccgcctcggcctcccaaagtgctgggattacaggcgtgagccaccttgcctggccaaaaatctcagaattctttaagactgttttaattgctccatcagtaattttgaagcactttcctttttttttttttttcccctttttgtccctttccccaagccaccaattggatggatgaatgtttgacggggaagaggaagggtaggaggatgcatggatgagtggatgagtggatcgatggatgtattgataaatagatagaaccagtcatctgaagcaacttaagaattgtagccttgactccttgagactgtagatttcgatccaggaaacatttatttagcacctgccagatgccagaaatttataccatttaaaactcagtaagtcttttaaatatcaggaaggagagaagcgacatcatgatacatcctatgggtattaaaaagccaatagaatattatgaataattttatgctaataaatttaacaacttcaacatcataaacaaattccttgaaaaataaaaagtaccaaaattcattcaagaagaaatagataccagcctgagcaacatggcaaaatcccatctctacaaaacatcaaaaaaaaaaaaaattagtcgggcatggtggtgcacacctgtaatcccagcttgtcaggaggctgaagtgggaggatcacctgagcccagggaggtcaaggatgcagtgagccatggtctcaccactgcactctagcctgggtgacagaatgagaccccgtctcaaaaaaaaagaagaagtagataatctgaatagccctatatctatagaaacttaatagtgctgggagatataggtattattatcctcattttacagatgtgaaaattgaggctcagagaagtaaagtctattgctcaaggtcatgtggctagaatatggcagagccatgattcagatccaggtcttctgattcttattccagtgtcctttctagcataccatgttgcctctaaagattgcagctccttatttactagaaaattgttcctgcccaatctacatctccacctcaccccatcttttcttaagcactatgtttgtgtttttatcagtattatattcattgtctttggaatacatgttcttgtttgtgtttggaaaaaaaatctcttttaccagcttgcactcggaccaacttggaaaaaaaaaagcttaaatgtttttgctatgtacagtttaaaaatgtgaagtttgtagctttaactttttgtaagaaaatctaataacactggcttaagtgctgacttgaaatgctattttgtaaggtttggatgtaagtaatcaattgaggtcagcagtttgtatgagacatagcttcctccattgcccccactccttttttcttttttaagtttgagatgcttcctgtgtttttatgttagaattgttgttctccttcttttcttcttcctatacctcatcacgtttgttttaaataaactgtcctttggacc

SEQ ID NO: 180384 - DNA, 722 bp, Homo sapiens
  Payload ID: 15527
  Gene Symbol: STK4
  Gene Name: serine/threonine kinase 4
  ENST ID: ENST00000474717
  CDS Start-End: 258-722
gtttatagaagtttcagttctgaagtttaagaggagtttcacttcatcccttttcattttgaaggcagctgaaaaagttggatgaagatagtttaaccaaacaaccagaagaagtatttgatgtcttagagaaacttggagaagggtcctatggcagcgtatacaaagctattcataaagagaccggccagattgttgctattaagcaagttcctgtggaatcagacctccaggagataatcaaagaaatctctataatgcagcaatgtgacagccctcatgtagtcaaatattatggcagttattttaagaacacagacttatggatcgttatggagtactgtggggctggttctgtatctgatatcattcgattacgaaataaaacgttaacagaagatgaaatagctacaatattacaatcaactcttaagggacttgaataccttcattttatgagaaaaatacaccgagatatcaaggcaggaaatattttgctaaatacagaaggacatgcaaaacttgcagattttggggtagcaggtcaacttacagataccatggccaagcggaatacagtgataggaacaccattttggatggctccagaagtgattcaggaaattggatacaactgtgtagcagacatctggtccctgggaataactgccatagaaatggctgaaggaaagcccccttatgctgatatccatccaatgagg

SEQ ID NO: 180385 - DNA, 1850 bp, Homo sapiens
  Payload ID: 15527
  Gene Symbol: STK4
  Gene Name: serine/threonine kinase 4
  ENST ID: ENST00000487587
  CDS Start-End: 17-211
ggctgctggcagcgccatggagacggtacagctgaggaacccgccgcgccggcagctgaaaaagttggatgaagatagtttaaccaaacaaccagaagaagtatttgatgtcttagagaaacttggagaaggttggaaaaatactctttggaatccagcaagaaatcaagcagagaagggaagtaaaaatgacacaccagctgtgctgtgaaaagacaagtccaagatgaatctgaagactgccagttgactggcatcattaaagagacgaggtctcactgtgttgcccaggctggtcttgaactcttggccttaagtgatcctcctgcctcagcctcccaaagtgctaggattagagacgtgaaccactgcacctggacaaattgcgttttagatctatggatgtcttctgcaaggaatgtggaaatttccctatgaagatatcaccagggagaaaacaaagcttcagatctttcttcccatactatcaccttattgttcttctaaataataccagatttctggtatttcttggatttctgttattctgactgaatgaacctaagcaagcctcatttaactaggaatattttgaaggaagaccttcactgcacttcttttccaaacatgtgacacaatgctattctttttttttgagattaagtcttgctctgtcaccaggctggagtgcaatgtcacaatctcggctcactgcaacctccgcctcccaggttcaagcgattcccctgcctcagcctcctgagtagctgggactataggcacacaccaccacgcccgacttattttttgtattttagtagagatggggtttcaccatattggccaggatggtcttgatctcgtgatcttgtgatctgcctgcctcagcctcccaaattgctggaattacagatgtgagccaccacgcctggccaatgctattcttaaattgttcgggaggatgaatggtttgtgaactctcactgacttgtatcttgtgaaatgagctatggctaaaaaaactgttggattctggaggctgcaatcattctgtgttatgaggatcatatggatctgtggcagagtagagccaaagctccagaccaggatgagtggagagcacttgggaagtgttttcaagtggagcctagcaccttttttcttctacttaaagttgtacacattgactcatttgaatttttatcatagaatgataacaaaagcatcttgcccatggtttcataaaaaatgagtgctattgttaagacttgtatctgattaatttggcctcagatactgtggtatttccatttttctacatagatccttgccttgcatggcttatgtaaaacacctacttctccattctctgctgtcagttgtaattcattgaatcatctcattttgttgtagggaatcaagttttaagggacttgcttgtgagtatgattgctgaaatcttctaaccaccccctatccctgccttcagattactgtagatgcagtatatggaatcaggaatcttaacttcatgtgagctattggagttttccttgctatcaggatgcatagggaggtatgaagagtgttctggtcaagattgctgagtgagtgtatgaagagaactttctaatatataagaataatgagtgaaaattattttaaatataaggatatatagacagctatggacaagggataggaaagaaatctaaataatcagcggagactaaagcatgccttatccttgtcaggagattgcatttgagcttcctgcatgaagttgggggctggaactcggctctccatctgtgaactaaagctgaaataaatttgcctgaccacaacca

SEQ ID NO: 180386 - DNA, 4837 bp, Homo sapiens
  Payload ID: 15528
  Gene Symbol: STK40
  Gene Name: serine/threonine kinase 40
  Uniprot ID: Q8N2I9
  ENST ID: ENST00000359297
  CDS Start-End: 9-1262
agctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggtgagttggggagggcagatgggccattacccagccccaagggacaggcttctgggggcaggcagggcaagggcagaggtggcagctacccgcaggccacagagtttccttggtcttcttccccagccttggggtgggaaagggagacttcagtcctcagcctgagctgcctggggcctgccttgggcttggtgtagctggagatctttggccagagagacctgtgagacagccgagctggagccagtgcccaagtggcccaggccagccctctcagcttcctcctgctgcccaagtcacatttctctgccccctgactcagagttctctctcacccttcctgcttttcatttttcagatgattcatttctccctatttctttcctccccattccctgcactggagaaagtgttgggcctagggtgggggcagagacttgggcaccaggcagcagagggcaggtgatcttagggtgccccctggagggcagggcttggccgagcaacagcattgctgggccctggatattggaaggaccttccctccctggcccaccttggagctccacagtgagcagtgtgcaggtaggaccaggaggggccgtgcctgggagagcctcccagagcctcctggcccccgaggaaagagagttccaatccctacccacctccagcttccaccctttagctgtttggctaaaatcatcatcactagcccgcagtgagtgcctaccccgagggcacctcattcagccctcactgcgggcctgcgtggcctgtgttcttagccccatgttacagaagaggaaacagggttagagaggactttcccaaagccacacagcttagaagtagtggagctaagccttgaacccaagtctcatccggaagccctgctgtctcctgtggtgactggcacggggacaccacttcagcttctgttaccatctgcctagaccatcccagggagctcagcatggggccctgcgtatgtggctcctccaggtgctgcgcccccagcccagggcttgctcgtacctcttgacgtgcattagccgcctcagggctcagagaacctttgcgaggggccagacagctaaggcttctgaggtaaagtgacctctcacgcagccagtgagttaggaagcatgagtctgcgtcagtcccgggtccgcagggcggcctgcaaggggagttgaggttggctggagggggtcagggacccaccctcagcgccactcccacccccggccttgaggcctgagggtgtggtgcctggaagggtgactgcaggagccaggctgccagcactcttgcctgccctcctgtctgctgcgctgccttcatctgggtttatctttgtctccttcccaccctccccgcctcaaaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 180387 - DNA, 3846 bp, Homo sapiens
  Payload ID: 15528
  Gene Symbol: STK40
  Gene Name: serine/threonine kinase 40
  Uniprot ID: Q8N2I9
  ENST ID: ENST00000373129
  CDS Start-End: 408-1715
ggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagtgcacacacccagaagctatgtccttcggcagtaaaagttttacagcacaatatatgtgctctgctctcctcccgcaatcctgctccaagagatcttaagctggaggcaccaggtctgaattccagactcctccccaccacccacacttcacctccaactggagcatgaccacagacccattcagggaggctggcggactcttcatcctggacagtcccttactgtatgtcaagtagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 180388 - DNA, 3628 bp, Homo sapiens
  Payload ID: 15528
  Gene Symbol: STK40
  Gene Name: serine/threonine kinase 40
  Uniprot ID: Q8N2I9
  ENST ID: ENST00000373130
  CDS Start-End: 175-1497
gggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttgctctctgtgccgtaggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 180389 - DNA, 3621 bp, Homo sapiens
  Payload ID: 15528
  Gene Symbol: STK40
  Gene Name: serine/threonine kinase 40
  Uniprot ID: Q8N2I9
  ENST ID: ENST00000373132
  CDS Start-End: 183-1490
gccatggagggaggcggcggcggcggcggcggcggctcgggtggctgcgctgggaggcggcggtgagaggctcgcacgcctccagcccggccccggccccccgggagggagagccgagcagccccggctctgggctacggactatgggcgaatagctctgaccacccggcgaagagctgagaatgaagcggagagcatcagacagaggagctggggaaacgtcggccagggccaaggctctaggaagtgggatttctggaaataatgcaaagagagctggaccattcatccttggtccccgtctgggcaactcaccggtgccaagcatagtgcagtgtttggcgaggaaagatggcacggatgacttctatcagctgaagatcctgaccctggaggagaggggggaccaaggcatagagagccaggaagagcggcagggcaagatgctgctgcacaccgagtactcactgctgtctctcctgcacacgcaggatggcgtggtgcaccaccacggcctcttccaggaccgcacctgtgaaatcgttgaggacacagaatccagccggatggttaagaagatgaagaagcgcatctgcctcgtcctggactgcctctgtgctcatgacttcagcgataagaccgctgacctcatcaacctgcagcactacgtcatcaaggagaagaggctcagcgagagggagactgtggtaatcttctacgacgtggtccgcgtggtggaggccctgcaccagaaaaatatcgtgcacagagacctgaagctggggaacatggtgctcaacaagaggacacatcggataaccatcaccaacttctgcctcgggaagcatctggtgagcgagggggacctgctgaaggaccagagagggagccctgcctacatcagtcccgacgtgctcagcggccggccgtaccgtggcaagcccagtgacatgtgggccctgggcgtggtgctcttcaccatgctgtatggccagttccccttctacgacagcatcccgcaggagctcttccgcaagatcaaggctgccgagtataccattcctgaggatggacgggtttctgagaacaccgtgtgtctcatccggaagctgctggtccttgacccccagcagcgcctggccgccgccgacgtcctggaggccctcagtgccatcattgcatcatggcagtccctgtcatctctgagtgggcctttgcaagtggttcctgacattgatgaccaaatgagcaatgcggatagctcccaggaggcgaaggtgacggaggagtgctcccagtacgagtttgagaactacatgcgtcagcagctgctgctggccgaggagaagagctccatccatgacgcccggagctgggtacccaagcggcagttcggcagcgcaccaccggtgcgacggctgggccacgacgcacagcccatgacctccttggacacggccatcctggcgcagcgctacctgcggaaataacagcctcagccggggccaccagcactgctgccacttcttccagccccagccaaaggcgtggctgtcagggctgggccctgtagtgctggactctcccgggccacaatagggacagggcagggacagggacagcccaggtcacacgtggggtcagcagaggtaccacgaagctaccttttgggatgattgctcgattgtttggtttttaaatctgagaagcctagataactaatctgcttttaatcacgatgttttaatctacctctgtctctttaaccatgctgtctctggactgagcaagagggaggagggagcctgctcaccccactccagggccttccccagcggccaccaactgacctggggcgctgctccccacagtccaaataagctgaaagtgcagctcgctgcaggccccagagcgagcttcccctcctccctgctctcccaggcccctgccacagcctctttccgtccctctctttctgatccaggcccctcagtccaagctttggaaaaccttcacctcatcttaaaccgaactcaaatatatttatttttttaccataccaacttctctcccatctctaggtggctcagtccatggccactccctgcccccagcctggctggacagcaaggaatccacagcccacacgtgagctccctcctcacccccaggcagggaagcccctcctgccagtccctgtcccctttcagcccaccagtccctctctgctgccggtgatgggaggcctttctagacctggctctttctctcccgtctcagtggcttctctgaggtgctgtacacgcgcgttaacctgttcccttctctatccttccccgtggtactgagctcacgtggactcccagtgcgaaggggcccatgggttgggctgcaggcctggccgtgagcgggggctgcctgcacgctcccctagcctactcttgtgtttaggggatggtgggaacatatcccagtgcccttgcctcataatagatgtggtgactctcccggtagaccctagcaagggtcctccatggtggtgagggactcaggagaattgtagggattgggggaccctgcctgcctggcttgagaacagccctgctgcccttttgagccgagattttgaagtggatgcccgtcttgccagaaatgctgttctcaccagaatgccccctccccttgcccttactggacttggccctgcctgatgccaagcaaagacccttccccagaggcctaccccccatatgtcctcagagaggctgagtgtcccctccaggcagtcatgggccctgaggcccctcctgcctggccctgctccccagtggggaggtgactgtgtttcccagagtgtgagccgctctcctccccctaaaaagctgactcactgtgagtgaccttgggcaagttcccaaacctccttgtgcctcagtttccccatctggaaaaaatggggccacctcttgccagcagtagcagggctgcccacgcccctttctccccatgccccatccagcacttgggcgactcatgcctctgcctcagtgggcctgtgggagcctactggagcccagcacttactccccctgagcagcgagcctgcgtctgtctcagctgtccagcgctgagggccagggtcttgtgctgtggggctgggggatgccctcttttctatatttatttcatagaaagtctcctgcgggagcggaaatgcagtccggcctagggctcccagcccttgactgtcctcctgtgagggcctgaagctgggccagggcccgtcgcagcggagccccctctcagcagcccaccgggtccctccaggctgctgcccgtgcgtggtctttctcctccttttcaaagcaatagccgccgggtctgcaaagccctgtcagacagactgggcccttccaaggtcaagccatgtgtctgatgacattcctggtgaagcaaaggagaggaggatgggtcagccctcactgggtgtcacacactgagagaagtcctattgtaaagaaacggaaaaagtcacaaaaaagtttgtataaagacatatttttgtactacatggggactcttcctgcatgtcagcaataaaacttcctgatctggaaccac

SEQ ID NO: 180390 - DNA, 1442 bp, Homo sapiens
  Payload ID: 15529
  Gene Symbol: STRAP
  Gene Name: serine/threonine kinase receptor associated protein
  Uniprot ID: Q9Y3F4
  ENST ID: ENST00000025399
  CDS Start-End: 315-1406
acttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaaggagctggtcagcatttgcctagactctcgggacaacacgatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgact

SEQ ID NO: 180391 - DNA, 1866 bp, Homo sapiens
  Payload ID: 15529
  Gene Symbol: STRAP
  Gene Name: serine/threonine kinase receptor associated protein
  Uniprot ID: Q9Y3F4
  ENST ID: ENST00000419869
  CDS Start-End: 314-1366
cttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagatggtaaacctatgctacgccagggagatacaggagactggattggaacatttttgggtcataaaggtgctgtttggggtgcaacactgaataaggatgccaccaaagcagctacagcagctgcagatttcacagccaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgtttttagttgtctaaataaaatgcctctaaaacaaaa

SEQ ID NO: 180392 - DNA, 1698 bp, Homo sapiens
  Payload ID: 15529
  Gene Symbol: STRAP
  Gene Name: serine/threonine kinase receptor associated protein
  ENST ID: ENST00000541731
  CDS Start-End: 324-464
gtcacttcctgccgatgccggtgtggacgctgtgaatcgtggctggcccggttctccgcttctccccatcccctactttcctccctccctccctttccctccctcgtcgactgttgcttgctggtcgcagactccctgacccctccctcacccctccctaacctcggtgccaccggattgcccttcttttcctgttgcccagcccagccctagtgtcagggcgggggcctggagcagcccgaggcactgcagcagaagagagaaaagacaacgacgaccctcagctcgccagtccggtcgctggcttcgccgccgccatggcaatgagacagacgccgctcacctgctctggccacacgcgacccgtggttgatttggccttcagtggcatcacgccttatgggtatttcttaatcagcgcttgcaaagcaaagtgtgggatgctgtctcaggagatgaattgatgaccctggctcataaacacattgtcaagactgtggatttcacgcaggatagtaattatttgttaaccgggggacaggataaactgttacgcatatatgacttgaacaaacctgaagcagaacctaaggaaattagtggtcatacttctggtataaaaaaagctctgtggtgcagtgaggataaacagattctttctgctgatgacaaaactgttcgactttgggatcatgctactatgacagaagtgaaatctctaaattttaatatgtctgttagtagtatggaatatattcctgagggagagattttggttataacttatggacgatctattgcttttcatagtgcagtaagtttggacccaattaaatcctttgaagctcctgcaaccatcaattctgcatctcttcatcctgagaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaagatagtggtgagctggcaaagccaaagattggttttccagagacaacagaagaggagctagaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatgccttttctttttttgcttcagttgtaaagaagagggaatacatgataaagtaactggtttgatttctcgttcattgtacactgcctctgaacatctaattgt

SEQ ID NO: 180393 - DNA, 648 bp, Homo sapiens
  Payload ID: 15529
  Gene Symbol: STRAP
  Gene Name: serine/threonine kinase receptor associated protein
  ENST ID: ENST00000538718
  CDS Start-End: 1-286
gaaagaatttcttgttgcaggcggtgaagattttaaactttataagtatgattataatagtggagaagaattagaatcctacaagggacactttggtcctattcactgtgtgagatttagtcctgatggagaactctatgccagtggttcagaagatggaacattgagactatggcaaactgtggtaggaaaaacgtatggcctttggaaatgtgtgcttcctgaagaaattgcttcagagaattcagattgcatctttccttcagctcctgatgttaaggcctgagcgtcaatcatatgtgcagttagtatacaactgactaaaacaagcaagcagagaaaagcatcagccttccagagttactgtctgcttaaggcagaaacagcagtaaataatgaggaaaatgaattagctccagtgctggaacaactaactaacttggtgttacctgtaagtgaaaactcaagtgtcagatgaagggaggtggagttatcctcttatagtacagtggcctgttatctttttaatgaatatatacaagccaacatccaatttctattattacaattagggttcttgtagctgtttatgttaatatggagaagaaaactatattggctgattttttctgatcttaaagcagaatg

SEQ ID NO: 180394 - DNA, 2825 bp, Homo sapiens
  Payload ID: 15530
  Gene Symbol: STKLD1
  Gene Name: serine/threonine kinase-like domain containing 1
  Uniprot ID: Q8NE28
  ENST ID: ENST00000371957
  CDS Start-End: 108-2150
agtgcctcgagggcgccgttcgggcggggaggatcccgcgggtcccactgacccacgcggggtggggccaggggtggacgctcgcccgtacgcggtcgctactgatcatgcttgggccagggtccaatcgcaggcgccccacgcagggggagcgaggcccagggtcccccggagagcccatggagaagtaccaggttttgtaccagctgaatcctggggccttgggggtgaacctggtggtggaggaaatggaaaccaaagtcaagcatgtgataaagcaggtggaatgcatggatgaccattacgccagtcaggccctggaggagctgatgccactgctgaagctgcggcacgcccacatctctgtgtaccaggagctgttcatcacgtggaatggggagatctcttctctgtacctctgcctggtgatggagttcaatgagctcagcttccaggaggtcattgaggataagaggaaggcaaagaaaatcattgactctgagtggatgcagaatgtgctgggccaggtgctggacgcgctggaatacctgcaccatttggacatcatccacaggaatctcaaaccctccaacatcatcctcatcagcagtgaccactgcaaactgcaggacctgagttccaatgtgctaatgacagacaaagccaaatggaatattcgtgcggaggaagacccctttcgtaagtcctggatggcccctgaagccctcaacttctccttcagccagaaatcagacatctggtccctgggctgcatcattctggacatgaccagctgctccttcatggatggcacagaagccatgcatctgcggaagtccctccgccagagcccaggcagcctgaaggccgtcctgaagacaatggaggagaagcagatcccggatgtggaaaccttcaggaatcttctgcccttgatgctccagatcgacccctcggatcgaataacgataaaggacgtggtgcacatcaccttcttgagaggctccttcaagtcctcgtgcgtctctctgaccctgcaccggcagatggtgcctgcgtccatcaccgacatgctgttagaaggcaacgtggccagcattttagaggtcatgcagaaattctctggctggcccgaagtccagctcagggccatgaagaggcttctgaaaatgcctgcagatcagctaggtctgccgtggcccccggagctggtggaggtggtggtcacgaccatggagctacatgacagggtcctcgatgtccagctgtgtgcctgctccctgctgctgcacctcctgggccaagcgctggtgcaccacccggaagccaaggctccctgcaaccaagccatcacctccaccctgctgagtgctcttcagagccaccccgaggaggagccacttcttgtcatggtctacagcctgctagccatcaccacaacccaggagtcagagtcactgtcagaggagctgcagaatgctgggctgctggagcacatcctggagcacctcaacagctccctcgaaagcagggacgtctgcgccagcggcctgggcctgctctgggccctcctgctggacggtatcattgtgaacaaggcccccttggagaaggtcccggacctcatcagccaggtgttggccacctaccctgcggatggggaaatggcagaagccagctgcggagtcttctggctgctgtccctgctgggctgcatcaaggagcagcagtttgaacaagtggtggcgctgctcctgcaaagcatccggctgtgccaggacagagccctgctggtgaacaatgcctaccggggactggccagcctggtgaaggtgtcagagctggcggccttcaaggtggtggtgcaggaggagggcggcagtggcctcagcctcatcaaggagacctaccagctccacagggacgacccggaggtggtggagaacgtgggcatgctgctggtccacctggcttcctatgaggagatcctgccggagctggtgtccagtagtatgaaggccctgctccaggagatcaaggagcgcttcacctccagcctggtgagtgacagcagcgccttcagcaaaccaggcctccctccaggtggaagcccccagctggggtgcaccacgtctgggggactggaatagatgtttgtatggaactgaccttgatctccacgtgtatagttttcaagactgctctcctgcctgcctattatcccatctctatgactgggccaaaatcaatcttaaacgggaggggtaatcagacctctccaaagagtttcctgtccatgactgctggattgagtcacatgagtaactgctcctggacccggggactgtccacgaaaactgacttgcctgcttcctccttccaggaactggtttcttgcgcggaaaaagtgctcttgaggctggaggcagccacctctcccagcccactgggtggggaagcagctcagccctgatgcgggggagaagacagataccccacaggcccctccctccacgtgtgccctctccctgtccttcctttccatgggccactgtttcccttggggtggggggaagggtcatccagcaccagaatgcgcatctcacactcctcttaggtgactaataaagaggcccaaggccagtttctgccttaatcatttctggcaagaggctgtgactggccagtgggatacttaattctgcagtctctatagacctcgcccctggacagagcagtccttccagaccattctagatgagagtcaacactgagcctccacaggctccattccaagtaaacatctgcatttattttaaatcgca

SEQ ID NO: 180395 - DNA, 2825 bp, Homo sapiens; identical to SEQ ID NO: 180394
  Payload ID: 15530
  Gene Symbol: STKLD1
  Gene Name: Serine/threonine kinase-like domain containing 1
  ENST ID: ENST00000627962
  CDS Start-End: 108-2150

SEQ ID NO: 180396 - DNA, 3179 bp, Homo sapiens
  Payload ID: 15531
  Gene Symbol: STK26
  Gene Name: serine/threonine protein kinase 26
  ENST ID: ENST00000354719
  CDS Start-End: 217-1395
atcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcacaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 180397 - DNA, 3288 bp, Homo sapiens
  Payload ID: 15531
  Gene Symbol: STK26
  Gene Name: serine/threonine protein kinase 26
  Uniprot ID: Q9P289
  ENST ID: ENST00000394334
  CDS Start-End: 254-1504
ctcctcttcctaaagcggcgaggcgcagaggagcggcatcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 180398 - DNA, 3017 bp, Homo sapiens
  Payload ID: 15531
  Gene Symbol: STK26
  Gene Name: serine/threonine protein kinase 26
  Uniprot ID: Q9P289
  ENST ID: ENST00000394335
  CDS Start-End: 214-1233
actcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcacattttgatctttagttgactctacagtcatgaaacatacaggtctttcaaagtcattctcaatattcagcttttgtaaattatcaagcttcaaaaagcttttttttttaaaaaaaaacatgcatattctaaaaatgactattggtggggaggtgtaaataagtcataccttcttaaaacagaaaatttaagtaaagtcttttaaatgaaacctgtaaaagtattgactcttctaccaagttggtatgatattccaggcagctcaatgattatcacatttgagaccctgtgtttgaagcatttacaggcaatgtacagcaacagaggtacctcttggtgtatagtatttacattctcttttaggtagaagaggcaattttacccttatttcacatggttagaaatttaaagcaagatcatttacccaaggataggtgtttggtaatgttgaaggagttagtctggcttcatgttttacatcttcaactaaaatcccatactatctgcttggatttggagagccaaaaaataaagctgattgtcatgtgattaaatatctgatcaacaggtatgaatataacttaaatcagcatatttttgccatggtaataaattgtcctataaactatttatatatttttgttcttcataattatcactaataagcatcagtttgttgtttttaaaaggatatttaagtgagcattttctagttcatatgaaaataaccatagtacaggatgatttctgtccacacaaaggttaaattagattgcacagttaattttcacttatatttatggtactattatgtgggtgatgcctttttcttttaagcccagtacatatattatgcctgcctaagttctgaactggggctgtatttcagtagttgtagaattattgatatttagttttgatagctaatgtttaattgtttggatctgcacagtttggtttttgcacaaaagtcatttaaaaaaatctgagtaattgtcaaatattaaaagaaagatattcttcctgtaaggaatacagtttttagtcaaagtggccattacatcctctttttaatttacataatacagatacttgagaaagttgttgtggtgttgtatgccaagaaaattctttttattggtgcctatattgtaacaattatttttaatgcattgtattttgaagtaacggttcagttaaatttttcacctgctgtgtaactgaaacacaattacagtttataatcatctgtagaagtctggagataattttgcaactcatgttatgggttaaatgaatatttttgtaaaagtaaaagcaacaaatttataaattgattatttgaaactttacaacacaattgcatcccaaatacaaattgtattgcttattcattatagctattcgtcctgtaatctgtttctaggtgaagcatactccagtgttttaggggttttgaaaataaatatttaaatttcacagtc

SEQ ID NO: 180399 - DNA, 1835 bp, Homo sapiens
  Payload ID: 15531
  Gene Symbol: STK26
  Gene Name: serine/threonine protein kinase 26
  ENST ID: ENST00000481105
  CDS Start-End: 217-1533
atcactcgagcccaggtcccagccaccaccactcacagcgctcggcgttcaggaagaggagcagcagcggaggcggctgcttcagcggcgggcgggcgccagaaaggccccgatcgaaaagcctgggagggccgccgaactacccccggagggaggagccagtccgaacccaaggcgccaccgccgcagaagcggagcgaggcagcattcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggatcatgggattagcagacacctgaagttccagcagatggaggtgttactacatagcagaaaactggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaagctgacatttggtcattgggaattactgctattgaactagccaagggagagccacctaactccgatatgcatccaatgagagttctgtttcttattcccaaaaacaatcctccaactcttgttggagactttactaagtcttttaaggagtttattgatgcttgcctgaacaaagatccatcatttcgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgcaacactgaagatttggaagaagctattaaactattttgtgatggcgtttatcattttatattttgaaaggattattttgtaaggaataacttttaatactatagtttcacctgtattctagtaaatgttgagacaccgttttgcttttaagtatccctatttcttaagttacgaggatgaatacctttcaca

SEQ ID NO: 180400 - DNA, 1186 bp, Homo sapiens
  Payload ID: 15531
  Gene Symbol: STK26
  Gene Name: serine/threonine protein kinase 26
  Uniprot ID: Q9P289
  ENST ID: ENST00000496850
  CDS Start-End: 11-1075
attcgcctccatggcccactcgccggtggctgtccaagtgcctgggatgcagaataacatagctgatccagaagaactgttcacaaaattagagcgcattgggaaaggctcatttggggaagttttcaaaggaattgataaccgtacccagcaagtcgttgctattaaaatcatagaccttgaggaagccgaagatgaaatagaagacattcagcaagaaataactgtcttgagtcaatgtgacagctcatatgtaacaaaatactatgggtcatatttaaaggggtctaaattatggataataatggaatacctgggcggtggttcagcactggatcttcttcgagctggtccatttgatgagttccagattgctaccatgctaaaggaaattttaaaaggtctggactatctgcattcagaaaagaaaattcaccgagacataaaagctgccaatgtcttgctctcagaacaaggagatgttaaacttgctgattttggagttgctggtcagctgacagatacacagattaaaagaaatacctttgtgggaactccattttggatggctcctgaagttattcaacagtcagcttatgactcaaaacgtcctacagcaaaagaacttctgaaacacaaattcattgtaaaaaattcaaagaagacttcttatctgactgaactgatagatcgttttaagagatggaaggcagaaggacacagtgatgatgaatctgattccgagggctctgattcggaatctaccagcagggaaaacaatactcatcctgaatggagctttaccaccgtacgaaagaagcctgatccaaagaaagtacagaatggggcagagcaagatcttgtgcaaaccctgagttgtttgtctatgataatcacacctgcatttgctgaacttaaacagcaggacgagaataacgctagcaggaatcaggcgattgaagaactcgagaaaagtattgctgtggctgaagccgcctgtcccggcatcacagataaaatggtgaagaaactaattgaaaaatttcaaaagtgttcagcagacgaatccccctaagaaacttattattggcttctgtttcatatggacccagagagccccaccaaacctacgtcaagattaacaatgcttaacccatgagctccatgtgccttttggatctttgca

SEQ ID NO: 180401 - DNA, 4857 bp, Homo sapiens
  Payload ID: 15532
  Gene Symbol: STYX
  Gene Name: serine/threonine/tyrosine interacting protein
  Uniprot ID: Q8WUJ0
  ENST ID: ENST00000354586
  CDS Start-End: 294-965
cctgtgctggatcctgggcggcctgaggggtacggagactctgggggagggagacggcagcggcatggcggccgggtgtaagacgcccgaccctcctcttccctgtcttcgccgccgccgctgctggagtcactgggaccctgtagtctgcgtgtgttagttgtaatcccgccgccctcctgtcagccctccgctccgccggccctccttccttccgccgccgcagccagcccgagggtcggccggctgtgtaacactctcccaccccacccaccagcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacatttttgtgtaatttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaattcctattgacccaggtgatatttctcttctgatttccctccccttcccttctcttatcttaccactgtgaaaacagcatattgttaatctcgttgtcgtccagtattctgctttgtgattaggtcttttgatgtacagtggtctagtggagtcaagattcgcattgggttttctaaaattccagttgataaaagttccagataacacagctttcctgtatatagatcactattgggcaggtcagcaaagatctcttacagtgtaataataatctatgatgcttcatttagcagaaactctgcttaaaagaatcttcataatagtaagtttaggttttaaaaacttgtttcataaatatacatatatcctctctagtagtctggccaaaagaacagattttgttattgataatttgtagctggtaattttccacattttctatccactgtaatttttatgttgtcactgaagtgcctgcccagtactgtatattacagtctctcacaaacactgggaaaagggactgtcatcatcttgagtactctgtgtgtatatatatatatatagatagatagatttttttttttttttgagacagagtctctaatgtcacccaggctggagtacagtggcacaatcttggctcactgcaacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgcttttaacatttgtacttggataaaatgcttatgtctgtataggaatgtcacagtgcaagatgctgctagcccaggcacaaagtattaaaattattttgtgaagattggtggttgtattaaaactgctgtgccattatacctccaaaatattgaaaa

SEQ ID NO: 180402 - DNA, 4554 bp, Homo sapiens
  Payload ID: 15532
  Gene Symbol: STYX
  Gene Name: serine/threonine/tyrosine interacting protein
  Uniprot ID: Q8WUJ0
  ENST ID: ENST00000442123
  CDS Start-End: 48-719
ttcctgtgctggatcctgggcggcctgagggcccgcgggccagcaccatggaggacgtgaagctggagttcccttcccttccacagtgcaaggaagacgccgaggagtggacctaccctatgagacgagagatgcaggaaattttacctggattgttcttaggcccatattcatctgctatgaaaagcaagctacctgtactacagaaacatggaataacccatataatatgcatacgacaaaatattgaagcaaactttattaaaccaaactttcagcagttatttagatatttagtcctggatattgcagataatccagttgaaaatataatacgttttttccctatgactaaggaatttattgatgggagcttacaaatgggaggaaaagttcttgtgcatggaaatgcagggatctccagaagtgcagcctttgttattgcatacattatggaaacatttggaatgaagtacagagatgcttttgcttatgttcaagaaagaagattttgtattaatcctaatgctggatttgtccatcaacttcaggaatatgaagccatctacctagcaaaattaacaatacagatgatgtcaccactccagatagaaaggtcattatctgttcattctggtaccacaggcagtttgaagagaacacatgaagaagaggatgattttggaaccatgcaagtggcgactgcacagaatggctgacttgaagagcaacatcatagagtgtgaatttctatttgggaaggagaaaatacaagagaaaattataatgtaaaatggtaaaaacataagtagtttttttttcaattacatgttgcttccagacatacttctctgcaacttgttgagcaacattttaagatgttggacttctgcaatagatgacactgatggttttactcctttttttaaaaacacatgcgcgcgcacacacacatgctttacaagttttattataaaccaagaattttggacttgcaaagaggtattattgcaataatgcacttttcatacttgaaatttatttgtatgatataaagttattactttaaacaaaatgcaagtatggggggattgtttataaagtttgggtaatttataacaaaatttgctaaggtttgctaaaaattcatttttctgttctatatattacatttttaacataattttacagttcaattttatgatggagcctcttacagaaacattaacaaaatgcaggaatctgccacatttcttttttagtataacttaatagcttaattaccattttattttttatacttcttccattattaatctttaaatcatgatcctaattagctgtccttactttaacttgatctaattattgcttcctttcttattactttcctaatttttctatattttaaaaactacagtttccatgataaaaggaaaacgttttgatttatagtaccaagtgcttaaacacaaggatagtgttagattttcgagtgactttcctttttgcattttttggcagtaaaagccaaacgttgtatttgttcttttcagagttgtccagcccttttttcctttgtccaaaatgattctaaatagaatctaataaaccaatgtagcattatttttttctaaatgaagccccaaaaaagaaaagtgccttgcatcatttaaaaaaaataattaaatcctcatggcctctaaattagtatgtagaacactgaaaagttcttaacatttttgtgtaatttcctttctttttaaaccataaattagtttaaactgaaagtacgaggctggaagaaatattagtaaattatttggaatatagaatgtttactctttctttttatgttgtcttaatgattctgtgagattgttccggctcaaacagaagcttttctttggggaaggtgatttgtgggagactagtgtattttaaattagcattttaatccattcttgacattcagttagtccagatctgccccataatttgctttagtaaagtcactttatggatttttggctatgttttagtttgtgtgtataaaagttctaagaaaacatttttgctattttaagtatgtaagggaagagaggagtgtttttaactttttatagttgatgactttagggtagcacaaacaaaactcctttgtatctaacttttctcaatcctctcttgaggtgctttactaatgggaatgatttctgtatgttcccttggtaccaagaggtactatgcaaagtaacctattacaccaagttacttgctttgctttcctctctatgatgtgataatacagtaaaagctttcttacccagcatagtgggagagtggagattaattaaaattgttaattaagagttaattcctattgacccaggtgatatttctcttctgatttccctccccttcccttctcttatcttaccactgtgaaaacagcatattgttaatctcgttgtcgtccagtattctgctttgtgattaggtcttttgatgtacagtggtctagtggagtcaagattcgcattgggttttctaaaattccagttgataaaagttccagataacacagctttcctgtatatagatcactattgggcaggtcagcaaagatctcttacagtgtaataataatctatgatgcttcatttagcagaaactctgcttaaaagaatcttcataatagtaagtttaggttttaaaaacttgtttcataaatatacatatatcctctctagtagtctggccaaaagaacagattttgttattgataatttgtagctggtaattttccacattttctatccactgtaatttttatgttgtcactgaagtgcctgcccagtactgtatattacagtctctcacaaacactgggaaaagggactgtcatcatcttgagtactctgtgtgtatatatatatatatagatagatagatttttttttttttttgagacagagtctctaatgtcacccaggctggagtacagtggcacaatcttggctcactgcaacctccacctcctgggttcaagtgattttcctgcctcagcctcccaagtagctggggttagaggcacatgccaccatgcctggctaatttttgtagttttagtagagatggggtttcaccatgttggccaggctggtctcaaactcctgacctcaagtgatccacccacctcggcctcccaaagtgctgggattacaggcgtgagccactgcgcctggctgagtacaatattaatgtagacaaaccatgaagtttattatttcatataagaacattacaggtttgttttttcttgcatgtctgtccacctaatgtttaagtagttctggtagctcttcctattctttattctatttgattccatttctgtgattcttttattaccactgatgttttgtgatagttaactatgataaatttaactgatcatgatttatcttctagagtatttaaataatgtatgagtgaccacccaattccaacattaaaagtgtaatctgggcccataatttatagtgaaattgtatcaaaacatagggaaactgtattactgtccattttgaaaatatgaaacttgagtattgaaaatattcaaacatggaatggcagtattctaatttcagttagttggttcatgttaatttcttacctgttagatgtttaaactgcagtgacctttacttgtatctactctgtggtggaaatgttaaaccatgatagcttttgctaccaactcaaccacttaacttttagagcagttttggggagagtttatgcttcatctgagtttagaagtaatgtcagaaaatgttaagcatgtctgtattaagaaaatataaggtttctaattgtcttattaatatggtaattcaagtgaattagaaatatttaactgcaatcttgaattataaagttgagatatatatatatatgtatcaagatctcaacttgatgtaaagtaaatgagcagttacctggcggatttttttttttttaaataactgatttaatccataatcccataacaaacatagcttcacctcagtattttctttctttctttgttcaacagtgctccgataagggaatgctagaaaatagatgagaagtactgaaagacctttttttttaattgattagaaaagtaagtctctagggtctttgaatgctggaatttttttttttttttttgtctttcccatctgtggcagctaaaacaaaaatcactcaaaatattcaggtttacatgttagctctctctcatagggagctgccatacctcacagttcaaagtgtattctatagatcagtaacattatactgacatgtaattgcaatttactatgcagcaaaaatgattcaagaagaaaaataacctacagtgtctgtatacctttgtatacacaattgcttaagttactctgcttttaacatttgtacttggataaaatgcttatgtctgtataggaatgtcacagtgcaagatgctgctagcccaggcacaaagtattaaaattattttgt

SEQ ID NO: 180403 - DNA, 1415 bp, Homo sapiens
  Payload ID: 15533
  Gene Symbol: STYXL1
  Gene Name: serine/threonine/tyrosine interacting-like 1
  Uniprot ID: Q9Y6J8
  ENST ID: ENST00000248600
  CDS Start-End: 344-1285
gccacttccgggagtcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctcatgtt

SEQ ID NO: 180404 - DNA, 953 bp, Homo sapiens
  Payload ID: 15533
  Gene Symbol: STYXL1
  Gene Name: serine/threonine/tyrosine interacting-like 1
  Uniprot ID: Q9Y6J8
  ENST ID: ENST00000340062
  CDS Start-End: 174-827
aggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 180405 - DNA, 1374 bp, Homo sapiens
  Payload ID: 15533
  Gene Symbol: STYXL1
  Gene Name: serine/threonine/tyrosine interacting-like 1
  Uniprot ID: Q9Y6J8
  ENST ID: ENST00000359697
  CDS Start-End: 307-1248
ctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaagcaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctca

SEQ ID NO: 180406 - DNA, 1127 bp, Homo sapiens
  Payload ID: 15533
  Gene Symbol: STYXL1
  Gene Name: serine/threonine/tyrosine interacting-like 1
  Uniprot ID: Q9Y6J8
  ENST ID: ENST00000360591
  CDS Start-End: 344-997
gccacttccgggagtcggaaaggaaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggtggggccccaggcagaggctccgacagggagcctggccatagtcgcgcagccggggaggtggagcgcgtcccagacccgagcccccgacctcagccaaacccattccttctgcccttggaggccagaggggactctgagctccggaaaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaaggcctttgctgcctgaaagtctcatgtt

SEQ ID NO: 180407 - DNA, 1147 bp, Homo sapiens
  Payload ID: 15533
  Gene Symbol: STYXL1
  Gene Name: serine/threonine/tyrosine interacting-like 1
  Uniprot ID: Q9Y6J8
  ENST ID: ENST00000431581
  CDS Start-End: 147-1088
cggtgtttggctgggttctagcgtagccgtctgtgtggccggtgggggacctgcggtcggagtgggagggccagtctgcacccaagaggtggaagaggacgggctttaggctggaagcgccttagaggagccatttttccagcaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggt

SEQ ID NO: 180408 - DNA, 651 bp, Homo sapiens
  Payload ID: 15533
  Gene Symbol: STYXL1
  Gene Name: serine/threonine/tyrosine interacting-like 1
  ENST ID: ENST00000430497
  CDS Start-End: 1-205
ccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaa

SEQ ID NO: 180409 - DNA, 764 bp, Homo sapiens
  Payload ID: 15533
  Gene Symbol: STYXL1
  Gene Name: serine/threonine/tyrosine interacting-like 1
  ENST ID: ENST00000438695
  CDS Start-End: 1-205
ccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagaggtcctgggcctatgtcaagaagtgcaaaaacaacatgtgtccaaatcggggattggtgagccagctgctggaatgggagaagactatccttggagattccatcacaaacatcatggatccgctctactgatcttctccgaggcccaccgaagggtactgaagagcctcacctgggggcattttgtgggtggagggccagagtgtgtatacccaggcttgtctggaaggagaa

SEQ ID NO: 180410 - DNA, 663 bp, Homo sapiens
  Payload ID: 15533
  Gene Symbol: STYXL1
  Gene Name: serine/threonine/tyrosine interacting-like 1
  ENST ID: ENST00000454618
  CDS Start-End: 1-663
catgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaggtcctgggcctatgtcaagaagtgcaaaaacaacatgtgtccaaatcggggattggtgagccagctgctggaatgggagaagactatccttggagattc

SEQ ID NO: 180411 - DNA, 1570 bp, Homo sapiens
  Payload ID: 15533
  Gene Symbol: STYXL1
  Gene Name: serine/threonine/tyrosine interacting-like 1
  ENST ID: ENST00000451157
  CDS Start-End: 171-1019
aaagctgtgggaccatcctggcaaccccggtgtttggctgggttctagcgtagccgtctgtgtggccggtgggggacctgcggtcggagtgggagggccagtctgcacccaagaggtggaagaggacgggctttaggctggaagcgccttagaggagccatttttccaggatgcctggtttgcttttatgtgaaccaacagagctttacaacatcctgaatcaggccacaaaactctccagattaacagaccccaactatctctgtttattggatgtccgttccaaatgggagtatgacgaaagccatgtgatcactgcccttcgagtgaagaagaaaaataatgaatatcttctcccggagtctgtggacctggagtgtgtgaagtactgcgtggtgtatgataacaacagcagcaccctggagatactcttaaaagatgatgatgatgattcagactctgatggtgatggcaaagatcttgtgcctcaagcagccattgagtatggcaggatcctgacccgcctcacccaccaccccgtctacatcctgaaagggggctatgagcgcttctcaggcacgtaccactttctccggacccagaagatcatctggatgcctcaggaactggatgcatttcagccataccccattgaaatcgtgccagggaaggtcttcgttggcaatttcagtcaagcctgtgaccccaagattcagaaggacttgaaaatcaaagcccatgtcaatgtctccatggatacagggcccttttttgcaggcgatgctgacaagcttctgcacatccggatagaagattccccggaagcccagattcttcccttcttacgccacatgtgtcacttcattgaaattcaccatcaccttggctctgtcattctgatcttttccacccaaggtatcagccgcagttgtgccgccatcatagcctacctcatgcatagtaacgagcagaccttgcagacggagtctcgctctgtcacccaggctggagtacagtagcacaatctcgactcactgcaagctctgcctcccgggctcatgccattcttctgcctcagcctcccgagtaactgggactacaggcatctgccaccactcaatttctttaatatatgtaggcctattcagattgtctgtttcttcttgtgtgagttttggcagtctgtgtctttcaaggaattgatcaatcacatttgtggatatgaatattcttctattatccttttaatgtctgtgggatctgtagcaatgtcttctctttcacttctgtattagtaatttgtgtcttctgtttaagttagcctggctagcggtgtatcgattttattgatcttttcaaagaaccggcttttggtttttttgattttctctattgatttcctgttttcaatttcattctttgcatggcgtatctagttttcctagcaccatttgttgaaatgactgtccttttcccccatcgaatggtcttggcatactatcaaaaattccttgacaggcccggtgcagtggctcacacctgtaatcccagcaggttgggaggcagaggt

SEQ ID NO: 180412 - DNA, 2995 bp, Homo sapiens
  Payload ID: 15534
  Gene Symbol: STYK1
  Gene Name: serine/threonine/tyrosine kinase 1
  Uniprot ID: Q6J9G0
  ENST ID: ENST00000075503
  CDS Start-End: 522-1790
ggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccacttaaggagacatccgtggaaaactttctgggagctaccacacctgccctggctaagctgcaggtgccgcgggagcaactctctgaagttctggagcagatttgcagtggtagctgtgggcccatctttcgagccaatatgaacactggggacccttctaagcccaagagtgttattctcaaggctttaaaagaaccagctgggctccatgaggtacaagatttcttagggcgaatccaattccatcaatacctggggaaacacaaaaacctggtgcagctggaaggctgctgcactgaaaagctgccactctatatggtgttggaggatgtggcccagggggacctgctcagctttctctggacctgtcggcgggatgtgatgactatggatggtcttctctatgatctcacagaaaaacaagtatatcacatcggaaagcaggtccttttggcgctggaattcctgcaggagaagcatttgttccatggggatgtggcagccaggaatattctgatgcaaagtgatctcactgctaagctctgtggattaggcctggcttatgaagtttacacccgaggggccatctcctctactcaaaccatacctctcaagtggcttgccccagaacggcttctcctgagacctgctagcatcagagcagatgtctggtcttttgggatcctgctctatgagatggtgactctaggagcaccaccgtatcctgaagtccctcctaccagcatcctagagcatctccaaagaaggaaaatcatgaagagacccagtagctgcacacataccatgtacagtatcatgaagtcctgctggcgctggcgtgaggctgaccgcccctcacctagagagctgcgcttgcgcctagaagctgccattaaaactgcagatgacgaggctgtgttacaagtaccagagttggtggtacctgaactgtatgcagctgtggccggcatcagagtggagagcctcttctacaactatagcatgctttgaagagtctcgggcaagaaacattcatgcatgagtatatgttcttggaatcaattcctctaagaacagagaatggtctttcccagggacacaaagggagaaatgggacatggattcttgatcttcctttacacatttctcgggaaatctgaaatgatgctggatgggactctacacatcctgagctaagacatactgtcagtctcacttctgctgtcccagtcctagaaatcctgggtagaagtggtggacctgtgcaaaggaggttttagaactctgcagtatttgttggggcatggcacaaataagctcatccctcccgtccgaggctagtttcctctggaaccacatttttatctagatgaaaatttggaatgaaatgaaggaatagaaatccaataaaagagttgaagggaaagaaaatttaaggttcttcttgctcaggattacagatatggaccaacacctccttcaagaaaaggtggtaggacacaaagttcttcagtcctgagccctacatgtggggttggaggagaactataacggaaaaacctctgagtttcaccttaggtatagataaaagaaagatggtccccttttatctgattctgagacaggtaaattctgtttgttactacgtttaattagaaggtggaggagtcatttcatgattaagaacattcaacatgtattgttcattaagctagcttcctagttccgattagactaaggagactaagcctagagagtcaatgttagaacagtgaaaagaattctgtgtgtgtgtgtgtgtgtgtgcacaataaataggaaatgtagaaaccaagcaagaaggcttagtagctcagtctttaacaagggctagaaaagaatgtaatctgatatggaaggatagcagcttctaattttcaatcatctgttgatatactgtgaaacttattttattaaattaatatttattaaatggaaatatgcttttctggtttataactactaaaaatatcatagggaggataaaagtaaataagtgaaagttaatgccaatagaaaaattcaagagataatgtacaatgtcagaaaagggattctttatgtgtaaatggggataatacctatttcacaaggttgttctgaggattgatacgttttgagtatgtatttgtacactatctggcacatatgcgctcaataaacgtgtttctcctttt

SEQ ID NO: 180413 - DNA, 249 bp, Homo sapiens
  Payload ID: 15534
  Gene Symbol: STYK1
  Gene Name: serine/threonine/tyrosine kinase 1
  ENST ID: ENST00000542924
  CDS Start-End: 1-249
ggcgaatccaattccatcaatacctggggaaacacaaaaacctggtgcagctggaaggctgctgcactgaaaagctgccactctatatggtgttggaggatgtggcccagggggacctgctcagctttctctggacctgtcggcgggtgagcagtagggcagaggatgtgatgactatggatggtcttctctatgatctcacagaaaaacaagtatatcacatcggaaagcaggtccttttggcgctgg

SEQ ID NO: 180414 - DNA, 520 bp, Homo sapiens
  Payload ID: 15534
  Gene Symbol: STYK1
  Gene Name: serine/threonine/tyrosine kinase 1
  ENST ID: ENST00000535345
  CDS Start-End: 325-520
gtcattatttcccctccgactgggccggtgccatcggaaaccggagtgaccagaggagggacacggaatctctggagacaggtaaaaatagaagcaagaaaaactgatagccctcagatttcataatttgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggtaaagctc

SEQ ID NO: 180415 - DNA, 543 bp, Homo sapiens
  Payload ID: 15534
  Gene Symbol: STYK1
  Gene Name: serine/threonine/tyrosine kinase 1
  ENST ID: ENST00000541561
  CDS Start-End: 422-543
atcgtgactccgttttcacctggactggagtcaccgtgatacctgacatctagcaatcactagagtaggaaatgagtatagatcagcaacaagtccagcctttacagttgcagcagaggtttcctgtggctcgagtgtggcgagtcccggaaacctcggagcccgcagacttcccttcgcgggagcccgcccgaactccatcctttgccggcagccacgccccgcagtgggaaggagggactgaaaagcatttccttgaggctggcacaccttgccctacccaaccctgtcattatttcccctccgactgggccggtgccatcggaaaccggagtgaccagaggagggacacggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttct

SEQ ID NO: 180416 - DNA, 586 bp, Homo sapiens
  Payload ID: 15534
  Gene Symbol: STYK1
  Gene Name: serine/threonine/tyrosine kinase 1
  ENST ID: ENST00000538867
  CDS Start-End: 338-586
attcctggagagggggccatcaggagagggggaagggaaagaatgaggttacaggaattacttgtcagaggactgcatagcctttcagaccatggaatcgttgctttcagcttcggcttcctcatctgcaaagcataaatacgcatccaatttcactgggctgcaagatatcaataagccttgcctctttaaactacttatgtacaaataaaagtgatggtgagaacctggctcaggaaatgcagtagcaggccatattgcatccaaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtg

SEQ ID NO: 180417 - DNA, 582 bp, Homo sapiens
  Payload ID: 15534
  Gene Symbol: STYK1
  Gene Name: serine/threonine/tyrosine kinase 1
  ENST ID: ENST00000542562
  CDS Start-End: 321-582
accttgccctacccaaccctgtcattatttcccctccgactgggccggtgccatcggaaaccggagtgaccagaggagggacacgagacagggtcttgctgaagaccctggctaaccaggctggcctggaactcctggcctcaagtgatcctcatgccttcatcttccaaagtgctgggattacagaagtcagccacggaggtcagctgacagctaattcttaacaattgacatggtcagagcaaatcgaaggaattactcacagctgtgctgtgtgcattctctgtgggcctagcagggaaggggacagccctgtggcaatgggcatgacacggatgctcctggaatgcagtctcagtgacaagttgtgtgtcatccaggagaagcagtatgaagtgattatcgtcccaactttgttggttactatcttcctcatccttcttggggtcatcctgtggctttttatcagagaacaaagaactcaacagcagcgttctggacctcaaggcattgcccctgttcctccacctagggacctaagctgggaagcaggacatggaggaaatgtggctttgccactta

SEQ ID NO: 180418 - DNA, 3207 bp, Homo sapiens
  Payload ID: 15535
  Gene Symbol: SERTM1
  Gene Name: serine-rich and transmembrane domain containing 1
  Uniprot ID: A2A2V5
  ENST ID: ENST00000315190
  CDS Start-End: 447-770
gagactagggggcggtgaggagtgggacccgctcgcggccattggttgtgcggccaggaggggcggagggacgacgcgcgggctgtgcggggccggcagcccggatccactcccgctgcgcctgctgtccgccgtgcgcccagactgcgcgccgcgccgctgcgcccaacattcccgaggacggcttcgcgggcgcgtatcgtccagaccggagcaccgccccaccgctagcgcaggagacctgccggggaagtcgcgtgtcctgacctgcagtctcaatgcacatctgatacctgctgcctttgagaaacaagttttgttgtgctgatttaacagcctgtgaattctgcaaacacgatcgtgaaaaaatgccaatctgtcctgtgtaagccctgtgtgaagttttgactttaatctaccagatcactccttcaccctccataaagatgtctgaacctgacacttcctcaggattttcgggaagtgtggagaatggaacttttcttgagctgtttcccacatccctgtccacgtcagtggacccatcctcaggccacctgtcaaacgtctacatctatgtgtccatattcctcagccttttagcgtttctgcttctgcttttaatcattgccctccagaggctcaaaaatatcatctcctccagttcctcctacccagagtatccaagcgacgctggaagttctttcaccaatttggaagtctgcagcatttcctctcagaggtccactttttcaaacctttcatcctgaggaaaatggaagagtccttgagtgtggcagcagttttgacatccccttacggaagtgtcccgtgaggcattgcctcatgaaagaaatgatccttttggtgtagacctgcttctccttctcctttttctctgatttcttttctgttcatgatgcttttcatttggggatggagacaccgatgttggtggaaatgtgtgcaaaccccaaggtgcagaatttcacacaaatggcttgatgaatctagactgggcttcttcaggtaagtcagttcattctactttgttggacgccgtaggctcatctgaggtggcctctccgtggatgctggacatggactcgcacttcatttcttttacaaagccgtgaaatcaactgagcctgcagaaactggcaaaatcaagtctgacctatgtagaagttattttccatatttaaaagataaagtggagacaccaaacttaaaaaggaagagagtcaatttagatttaatgtatgacatttctaaaactgagggtaaatatatgctaaatattttctttaacttcactttaacaagtaaaaatcacacttattgatgaatgtaagtcatttgggaaagttttggaagagtttacattttaatagcaagacaaacatgtattatgatggagcttgtgatgtatttctgcctcctggagttttattttgtttttctgcttatgttttagtcataatgccacaaagttgtggaatttttgtgattaattgctgttactagtactaagagaagcaccagaagagatgccaagaagtttttatatgaataatttctatcagtgagaattaagcatatggaaaatattcatttagttgtattttatacagtaataactcttagctgtcgtgtaagttcctttattcggtttcatagtctttataattttagtgcagaattatattaagcctccaagatgtctgatatttgttcactcacattaggttgtaaaacttagaaactaaattgcaaatatatgtgttattatatactccacgaatgttgcgtctctgataattagttgttgtatgttaacataatactctacattaggatttcaggatgtgagtttgtattaaaaattgtaggcactcaagttgtgtagctgctgggagctttagggatcctaggagctgccgtgctgcaggcagcagagtatgtctgaactcggcgggcgggtggcaggggctgtctgtgaaattaggcacacatgtgagctcagacatggaatgtggaggaactcaagctgcccctaaaaacaaaacaatcaaactgcagctccttaagagtaagaattttaatttaattttgaaaataaatggcccacagggtaaacactgaacttattcaacctacaggaggccactgcatcaacacgccacggtcttcccatggcaactgaatcattccttgttcaaaacatttaatcatcttaagcagtggggcttcaacacaccgtttggttagattgtgcagtcagcactctccagtgattagaatgggggaaagaatccactatttgtacagggtttatctttatcatactaaaatgctgagtgagtggaggtctgggaatgaaaatcagaagtcttcttcttcttttaattcataagcctcacttaaatcagaacacatttaactatttatatatcaaaaacgtccccaaacaccataagaccagcacagagttgctgccctaaaatgtataattagtgaaaaatttacctctgcttccatttaaagcatggcagtgggttgggtgtcattatgtagtataaaaactggactagataaactgctattttagagcattattagcattctctgaatatatgtatatatacatatatatacgcacacacacacacacacataaatatatatatatatatatatatataaactcacatactcccaattaaaagtcgtgtgaaagctacacaggattacagaggcatctatattatcacttttgctctttgactaatcctatgctgtttttgttatagagagaaacaaggacatggatgaagtgatttttttttaaataaaaggacaaatttgccacacaacagaacaatctgagtatgatctgtcctcagggtatctttatatcctttccatgtgaaagagatataaagaattctgacagcaaaactactttaaaaatcaaatcaaatcaaatccacaagcacactcccattcctcccctgccgcaatggttcttgctctcaatgtttagtagagaaattaagagccacattcaaagatggaaaataagatttgtcattagaagcttgccaaggtaacagattgtacaacttgagatgaattcatgttgtttaagaagttcagaaaggttggaagatgggtttataaataaagaagtggagtccattgaaa

SEQ ID NO: 180419 - DNA, 1159 bp, Homo sapiens
  Payload ID: 15536
  Gene Symbol: SSMEM1
  Gene Name: serine-rich single-pass membrane protein 1
  Uniprot ID: Q8WWF3
  ENST ID: ENST00000297819
  CDS Start-End: 52-786
agtcatctttatccctttaagcatggtttattttctgagcaaggagtcatcatgggagaccttttttccttattttgggaggtagatcctcccccaatacctgtaaattgtgccattccaaatcaggattatgaatgctggaaggatgactcttgtggaaccatagggagcttcctgctttggtattttgttatcgtatttgtcctgatgttcttctctagggcttctgtctggatgtctgaggataaaaaggatgaaggcagtgggacaagtacttcagtaaggaaagcaagcaaagagacttcctgtaagcggcaaagcaaagacagtgcctgggatccctcacaaacaatgaagaaaccaaagcagaaccaacttacccctgtaaccaactcagaagtggctttggtcaatgcctatcctgaacaaagacgagccaggcgccagtctcagttcaatgaggtgaaccagaaccaacatgacagtgatactacggagtatggcagtgaagagtctaactcagaagcctcctcgtggaaggagagtgaaagtgaacaccacccatcaccagacagtattaagaggagaaaaatggctcagaggcaaaggaatctgggaagttaccaaatgagcgaaaggcactgcctccactgcaaagccttgagaaccaacgaatggttggcgcaccattcccgacagaagccttcagtaacaccgccaatgaaaagagacagtcaagaggaaagttccatatctgacattaacaagaaatttagtaaattttgaattttatcacgttcttccttcacttgaagccaaatgaaagagatgaataaaacatgaaaaatcaccagagctataggtgaggagacttttacaacaaagtctctctaccaacaaacaaaaacatacttggaacccaagaggtaaaatctcacacaattcttcgttcaaaaaaaaaaaggccatcacgtgtttatggcaccattggaacaccaaagatctatatctgctatgatttttttatttgaaatagcacaagacagatattttgtgccttgagtgtatatattttgtgccttgagtgtatgtattttgtttatgtctgtaatatgaataagaaagctctttgaaaatgtattatttatgttgagaaacc

SEQ ID NO: 180420 - DNA, 2314 bp, Homo sapiens
  Payload ID: 15537
  Gene Symbol: SDCCAG3
  Gene Name: serologically defined colon cancer antigen 3
  Uniprot ID: Q96C92
  ENST ID: ENST00000298537
  CDS Start-End: 213-1451
cctcgccgacggcccaaggcgttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcacc

SEQ ID NO: 180421 - DNA, 2304 bp, Homo sapiens
  Payload ID: 15537
  Gene Symbol: SDCCAG3
  Gene Name: serologically defined colon cancer antigen 3
  Uniprot ID: Q96C92
  ENST ID: ENST00000357365
  CDS Start-End: 131-1438
ggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacagattttggctatggaaaggggaaatgttctaagcagagcccgtcaggagcccacgggacacattttggagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttcttatttaataaattctgtagttcaccgca

SEQ ID NO: 180422 - DNA, 865 bp, Homo sapiens
  Payload ID: 15537
  Gene Symbol: SDCCAG3
  Gene Name: serologically defined colon cancer antigen 3
  ENST ID: ENST00000371723
  CDS Start-End: 197-865
aggcgttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgattttggctatggaaaggggaaatgttctaagcagagcccgtcaggagcccacgggacacattttggagatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgca

SEQ ID NO: 180423 - DNA, 2129 bp, Homo sapiens
  Payload ID: 15537
  Gene Symbol: SDCCAG3
  Gene Name: serologically defined colon cancer antigen 3
  Uniprot ID: Q96C92
  ENST ID: ENST00000371725
  CDS Start-End: 204-1292
cggcccaaggcgttcaggcacgcgctttcggtgctcggagcggaagcagcggcgagaggctcggaggcgcgggggcggccgagcggcgggcgacgggggcgggcgacgggggcgggcgacgcgggccgcggcacgggcggagccggggccatggagccgccgctgccgggctaggcaggtcgtgccccgccgggccggcggcgatgtcgggctaccagcgccgcccgggcgccaccccgctgtcccgagcccggagcctcgccattcccgacgatgacagatttgaagatctggaagaggcaaatccattctcttttagagagtttctgaagaccaagaacctcggcctctcgaaagaggatccggccagcagaatttatgcaaaggaagcctcgaggcattccctgggacttgaccacaactccccaccctcccaaaccggcgggtatggcctggagtatcagcagccatttttcgaggatccgacaggggctggtgacctcctggatgaggaggaggatgaggacaccggatggagtggggcctacctgccgtccgccatcgagcagactcaccccgagagggtccctgccggcacgtcgccctgcagcacatacctttcctttttctccaccccgtcggagctggcagggcctgagtctctgccctcgtgggcgttgagtgacactgattctcgcgtgtctccggcctctccggcagggagtcctagcgcagactttgcggttcatggagagtctctgggagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcaggtggagcagaacctggagctgatgaccaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaagagtccagtgtcgtgccctcagccagttcttggccaccacaatgggagcagccctggccgagttgtctctgtggtttctatgcagcccttcttggcgaaattcctgcgatcttatagattctaatgagctcttggaagacattgtcataaaagccagtgattttaagaaaaagagtggttctggaatcaatgttttccagtcccatcccagaacatcagttgtaagataagtacaattggttgtccttgatttcataagtagaacaaacactaaatgtgcctctgagatggccaccccgggcagggacctgtgccttccgccgatgctcagggctccctctggctcccgggtcactcttgtggccccagtgggtggtccctgcagtcatggcctgagtgcgcaggggccaccgcgtggctgctgctgtcctcctccgggacccacggggaccaaggtcacacgttccgtgctgtgaagctgtccagatgtgcctctttggctgggggttctggtggacgtttcaagtggcattttgtacaatgcaggttagaattcaggaatttcaagtatgtgcccgggtctgtcaggtcccagttgcctttctgacggcccccctcagagggacggcgatgagcactaaatgcttttttgactattttcctatagattttttttaaaacttttttttcctcctgttccaattgatagctttc

SEQ ID NO: 180424 - DNA, 626 bp, Homo sapiens
  Payload ID: 15537
  Gene Symbol: SDCCAG3
  Gene Name: serologically defined colon cancer antigen 3
  ENST ID: ENST00000417512
  CDS Start-End: 1-503
gagacaggcacctgcggacgctgcagataagttacgacgcactgaaagatgaaaattctaagctgagaagaaagctgaatgaggttcagagcttctctgaagctcaaacagaaatggtgaggacgcttgagcggaagttagaagcaaaaatgatcaaggaggaaagcgactaccacgacctggagtcggtggttcagcagaaacgggctgtaaaggcagaaaaccacgtcgtgaaactaaaacaggaaatcagtttgctccaggcgcaggtctccaacttccagcgagagaatgaagccctgcggtgcggccagggtgccagcctgaccgtggtgaagcagaacgccgacgtggccctgcagaacctccgggtggtcatgaacagtgcacaggcttccatcaagcaactggtttccggagctgagacactgaatcttgttgccgaaatccttaaatctatagacagaatttctgaagttaaagacgaggaggaagactcttgaggacccctgggtgttctcagcatgaagctccgtgtataccctgaggtcaccaccgctcgatctaaatgtgcagttgtgtccttaaatatgcagtcttcacccagagtaaagtgttgatcgcaa

SEQ ID NO: 180425 - DNA, 459 bp, Homo sapiens
  Payload ID: 15537
  Gene Symbol: SDCCAG3
  Gene Name: serologically defined colon cancer antigen 3
  ENST ID: ENST00000446833
  CDS Start-End: 134-459
agtaaagtcgctgttgtcgttgcttccagctccagcgttctatgagcgccggtcttgtctcccccagctaaattgtgagcgcccccatggcagggacctggactcccccttcttcggcattcggccggcctttatgtgctatgtgcccagcccggtgctggcttccgtgggagacacaggtgagagacgagggcgccggccccggggacgcttccagttcccgcgccacgtgtggcacctccgctgcagcacgagctcgtccattgacccatcaatgtgcagagcgctcactgcgtgccaggcactcggaattcaaaggcggagtcccctgctaggagctcacagtctggttgcggggagacctcccccaagacagacagttccagtacaggatgatgacagatttgaagatctggaagaggcaaatccattctcttttagagagtttctgaagaccaa

SEQ ID NO: 180426 - DNA, 2567 bp, Homo sapiens
  Payload ID: 15538
  Gene Symbol: SDCCAG8
  Gene Name: serologically defined colon cancer antigen 8
  Uniprot ID: Q86SQ7
  ENST ID: ENST00000366541
  CDS Start-End: 119-2260
gtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaagac

SEQ ID NO: 180427 - DNA, 1551 bp, Homo sapiens
  Payload ID: 15538
  Gene Symbol: SDCCAG8
  Gene Name: serologically defined colon cancer antigen 8
  ENST ID: ENST00000435549
  CDS Start-End: 1-1245
cttctggatgcatccgagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaaga

SEQ ID NO: 180428 - DNA, 1871 bp, Homo sapiens
  Payload ID: 15538
  Gene Symbol: SDCCAG8
  Gene Name: serologically defined colon cancer antigen 8
  ENST ID: ENST00000476722
  CDS Start-End: 1-467
gacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactgaactttttgatcatctcaaacaaaaagtctggacgtattaaacaatatctccattcccctccctgccaacccctgatgacctctcttcaactttcggagaagctaaaacttacttatgaggaaaagtgtgaaattgaggaatcccaattgaagtttttgagaaataagaatcacggccgggcgcggtggctcacgcctgtaatcccagcactttgggaggctgaagcgggcgaatcacgaggtcaagagattgagaccatcctggccaacatggtgaaaccccgtttctactaaaaatacaaaaattagctgggcctggtagcacgtgcctgtagtcccagctacttgggaggctgaggcaggagaatcacttgaacctgggaggcggaggttgcagtaagctgagaccacgccactgcactccaacctggcaacagagtgagactccatttcaaaaaagaaaaaaaaaaaaaagaaataagaatcactaactgctcttatagaaattatgatattcaagtaaaataatgaaaataaagcactttagttttcaaattattagtattttttctctgtagatagtcttcatctaattttaaaattgcaatgataatataatagtttgagtatttgtatacatgatgaatttgagtatatatgatgaatattcatgtactttttatagaatctatttattagagatcccagtaagacctatatattatagattaaccattagtgatttatgtataatgagtagaaaaagacagcaggaattaatatttttgttgttaaagattatttttaaatagtagtaatgaagtaattttaaatcaaataaactttgaaatattgtttataattttattttaataagtccaatttgaaattttaaaatcttccaggccatagcctatctagagacataactagagtaatactaagagccagaactcagctgattgtggtggcttacgcatgtaatcccaacactttgggaagccaaggcgggtggatcatttgaggtcaagagttcgagactagcctggccaatatggtaaaaccctgtctctactaaaaatataaaaattagctgggtgtggtggcacacatctgtagtcccagctactcaggaggctgaggcagaatcacttgaacccaggagatagaggttgcagtgagccaagatcatgccactgcactccagcctgggtgacagagggagactccatctaaaaaaaaaaaaaaaaaaaaaaaccgagctggaactcatagctttcactgtacatggttgtttattttttaaatgttcttatgtttttcatagattaccctgattagttttaggatttctcttagagatttttacttttttacaaagaaatgttaacatttaaaaaatactctaatttttgctttcttgttttttgtcctattttattttattttgattttatttacgacttgattctttagtttttaaagtgatgtatttctagatcattgtacttaagggaatgtgacttattttgtctcattcagaatccagatatttcatctttaattacattaaaataccaacttgtaatgaattagactttgttctctgaatccttctgtttcttcattttcttttactataatttaagattatttaaagaggcattttcataaataaataaaatcagtcttcttttc

SEQ ID NO: 180429 - DNA, 2415 bp, Homo sapiens
  Payload ID: 15538
  Gene Symbol: SDCCAG8
  Gene Name: serologically defined colon cancer antigen 8
  Uniprot ID: Q86SQ7
  ENST ID: ENST00000622598
  CDS Start-End: 119-2260
gtgacagccgcggcaggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccgggaacatgccagcagaagcattcaccaactgacatgtgccctgaaagaaggcgatgtcactattggagaagatgcaccaaatctttcttttagcaccagtgtgggaaatgaggacgccaggacagcctggcccgaattacaacagagccatgctgttaatcagctcaaagatttgttgcgccaacaagcagataaggaaagtgaagtatctccgtcaagaagaagaaaaatgtcccccttgaggtcattagaacatgaggaaaccaatatgcctactatgcacgaccttgttcatactattaatgaccagtctcaatatattcatcatttagaggcagaagttaagttctgcaaggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtcccc

SEQ ID NO: 180430 - DNA, 2035 bp, Homo sapiens
  Payload ID: 15538
  Gene Symbol: SDCCAG8
  Gene Name: serologically defined colon cancer antigen 8
  ENST ID: ENST00000630785
  CDS Start-End: 153-1730
gttgttctcggaagggagaaagctggacatttccccacgtaactcccagctctgggcctagagtgcgtgcatggcgaagtccccggagaactctaccctggaggagattctggggcagtatcaacggagtctccggggaggaactctctggaatgaaaaataaaatacaagtagttgtgcttgaaaacgaagggctccagcaacagctaaaatctcaaagacaagaggagacactgagggaacaaacacttctggatgcatccgagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaag

SEQ ID NO: 180431 - DNA, 1536 bp, Homo sapiens
  Payload ID: 15538
  Gene Symbol: SDCCAG8
  Gene Name: serologically defined colon cancer antigen 8
  ENST ID: ENST00000630755
  CDS Start-End: 1-1230
gagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaaga

SEQ ID NO: 180432 - DNA, 2198 bp, Homo sapiens
  Payload ID: 15538
  Gene Symbol: SDCCAG8
  Gene Name: serologically defined colon cancer antigen 8
  ENST ID: ENST00000627744
  CDS Start-End: 187-1893
aggaagcaggcgggcgctccccggccacaggcctgttgttctcggaagggagaaagctggacatttccccacgtaactcccagctctgggcctagagtgcgtgcatggcgaagtccccggagaactctaccctggaggagattctggggcagtatcaacggagtctccggggaggaactctctggaatgaaaaataaaatacaagtagttgtgcttgaaaacgaagggctccagcaacagctaaaatctcaaagacaagaggagacactgagggaacaaacacttctggatgcatccggaaacatgcacaattcttggattacaacaggtgaagattctggggtgggcgaaacctccaaaagaccattttcccatgacaatgcagattttggcaaagctgcatctgctggtgagcagctagaactggagaagctaaaacttacttatgaggaaaagtgtgaaattgaggaatcccaattgaagtttttgaggaacgacttagctgaatatcagagaacttgtgaagatcttaaagagcaactaaagcataaagaatttcttctggctgctaatacttgtaaccgtgttggtggtctttgtttgaaatgtgctcagcatgaagctgttctttcccaaacccatactaatgttcatatgcagaccatcgaaagactggttaaagaaagagatgacttgatgtctgcactagtttccgtaaggagcagcttggcagatacgcagcaaagagaagcaagtgcttatgaacaggtgaaacaagttttgcaaatatctgaggaagccaattttgaaaaaaccaaggctttaatccagtgtgaccagttgaggaaggagctggagaggcaggcggagcgacttgaaaaagaacttgcatctcagcaagagaaaagggccattgagaaagacatgatgaaaaaggaaataacgaaagaaagggagtacatgggatcaaagatgttgatcttgtctcagaatattgcccaactggaggcccaggtggaaaaggttacaaaggaaaagatttcagctattaatcaactggaggaaattcaaagccagctggcttctcgggaaatggatgtcacaaaggtgtgtggagaaatgcgctatcagctgaataaaaccaacatggagaaggatgaggcagaaaaggagcacagagagttcagagcaaaaactaacagggatcttgaaattaaagatcaggaaatagagaaattgagaatagaactggatgaaagcaaacaacacttggaacaggagcagcagaaggcagccctggccagagaggagtgcctgagactaacagaactgctgggcgaatctgagcaccaactgcacctcaccagacaggaaaaagatagcattcagcagagctttagcaaggaagcaaaggcccaagcccttcaggcccagcaaagagagcaggagctgacacagaagatacagcaaatggaggcccagcatgacaaaactgaaaatgaacagtatttgttgctgacctcccagaatacatttttgacaaagttaaaggaagaatgctgtacattagccaagaaactggaacaaatctctcaaaaaaccagatctgaaatagctcaactcagtcaagaaaaaaggtatacatatgataaattgggaaagttacagagaagaaatgaagaattggaggaacagtgtgtccagcatgggagagtacatgagacgatgaagcaaaggctaaggcagctggataagcacagccaggccacagcccagcagctggtgcagctcctcagcaagcagaaccagcttctcctggagaggcagagcctgtcggaagaggtggaccggctgcggacccagttacccagcatgccacaatctgattgctgacctggatggaacagagtgaaataaatgatttacaaagagatatttacattcatctggtttagacttaatatgccacaacgcaccacgaccttcccagggtgacaccgcctcagcctgcagtggggctggtcctcatcaacgcgggcgctgtccccgcacgcagtcgggctggagctggagtctgactctagctgagcagagctcctggtgtatgttttcagaaatggcttgaagttatgtgtttaaatctgctcattcgtatgctaggttatacatatgattttcaataaatgaactttttaaag

SEQ ID NO: 180433 - DNA, 3236 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000355814
  CDS Start-End: 278-1534
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180434 - DNA, 1622 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000393087
  CDS Start-End: 266-1522
aggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaa

SEQ ID NO: 180435 - DNA, 1885 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000393088
  CDS Start-End: 556-1812
gtgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcgcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagc

SEQ ID NO: 180436 - DNA, 1628 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000404814
  CDS Start-End: 312-1568
atgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaa

SEQ ID NO: 180437 - DNA, 1450 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000402629
  CDS Start-End: 35-1114
ggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggtgagatcaccctgacgaccttgttgcaccctggtatctgtagggaagaatgtgtgggggctgcagctctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatct

SEQ ID NO: 180438 - DNA, 3144 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000440909
  CDS Start-End: 186-1442
tcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180439 - DNA, 3340 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000437397
  CDS Start-End: 382-1638
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180440 - DNA, 3532 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000448921
  CDS Start-End: 574-1830
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtcttggagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctgggggccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctatggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagctgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180441 - DNA, 1559 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000449399
  CDS Start-End: 303-1559
cacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataa

SEQ ID NO: 180442 - DNA, 446 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000554720
  CDS Start-End: 130-446
agcagcctcccccgttgcccctctggatccactgcttaaatacggacgaggacagggccctgtctcctcagcttcaggcaccaccactgacctgggacagtgaatctgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaa

SEQ ID NO: 180443 - DNA, 571 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000556955
  CDS Start-End: 221-571
agagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccat

SEQ ID NO: 180444 - DNA, 1562 bp, Homo sapiens
  Payload ID: 15539
  Gene Symbol: SERPINA1
  Gene Name: serpin peptidase inhibitor, clade A (alpha-1 antiproteinase, antitrypsin), member 1
  Uniprot ID: P01009
  ENST ID: ENST00000489769
  CDS Start-End: 10-930
tgcaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggtgaccaccgtgaaggtgcctatgatgaagcgtttaggcatgtttaacatccagcactgtaagaagctgtccagctgggtgctgctgatgaaatacctgggcaatgccaccgccatcttcttcctgcctgatgaggggaaactacagcacctggaaaatgaactcacccacgatatcatcaccaagttcctggaaaatgaagacagaaggtgattccccaacctgagggtgaccaagaagctgcccacacctcttagccatgttgggactgaggcccatcaggactggccagagggctgaggagggtgaaccccacatccctgggtcactgctactctgtataaacttggcttccagaatgaggccaccactgagttcaggcagcgccatccatgctccatgaggaggacagtacccaggggtgaggaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctgg

SEQ ID NO: 180445 - DNA, 583 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000557118
  CDS Start-End: 517-583
agagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccc

SEQ ID NO: 180446 - DNA, 643 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000556091
  CDS Start-End: 175-643
caggcaccaccactgacctgggacagtgaatctgttactgatgtcggcaagtacttggcacaggctggtttaataatccctaggcacttccacgtggtgtcaatccctgatcactgggagtcatcatgtgccttgactcggggcctggcccccccatctctgtcttgcaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggagg

SEQ ID NO: 180447 - DNA, 951 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000557492
  CDS Start-End: 518-951
actgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcag

SEQ ID NO: 180448 - DNA, 581 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000553327
  CDS Start-End: 304-581
aaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaa

SEQ ID NO: 180449 - DNA, 3340 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000620666
  CDS Start-End: 382-1638
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtctttgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggaccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctgtggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagttgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180450 - DNA, 3532 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000614317
  CDS Start-End: 574-1830
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtctttgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggaccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctgtggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagttgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180451 - DNA, 3236 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000618636
  CDS Start-End: 278-1534
tgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggtgggacattgctgctgctgctcactcagttccacaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtctttgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggaccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctgtggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagttgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180452 - DNA, 1559 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000627097
  CDS Start-End: 303-1559
cacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataa

SEQ ID NO: 180453 - DNA, 3144 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000627595
  CDS Start-End: 186-1442
tcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaaggacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaatccctcccatgttttctctgagtctccctttgcctgctgaggctgtatgtgggctccaggtaacagtgctgtcttcgggccccctgaactgtgttcatggagcatctggctgggtaggcacatgctgggcttgaatccaggggggactgaatcctcagcttacggacctgggcccatctgtttctggagggctccagtcttccttgtcctgtctttgagtccccaagaaggaatcacaggggaggaaccagataccagccatgaccccaggctccaccaagcatcttcatgtccccctgctcatcccccactcccccccacccagagttgctcatcctgccagggctggctgtgcccaccccaaggctgccctcctggggaccccagaactgcctgatcgtgccgtggcccagttttgtggcatctgcagcaacacaagagagaggacaatgtcctcctcttgacccgctgtcacctaaccagactcgggccctgcacctctcaggcacttctggaaaatgactgaggcagattcttcctgaagcccattctccatggggcaacaaggacacctattctgtccttgtccttccatcgctgccccagaaagcctcacatatctccgtttagaatcaggtcccttctccccagatgaagaggagggtctctgctttgttttctctatctcctcctcagacttgaccaggcccagcaggccccagaagaccattaccctatatcccttctcctccctagtcacatggccataggcctgctgatggctcaggaaggccattgcaaggactcctcagctatgggagaggaagcacatcacccattgacccccgcaacccctccctttcctcctctgagtcccgactggggccacatgcagcctgacttctttgtgcctgttgctgtccctgcagtcttcagagggccaccgcagctccagtgccacggcaggaggctgttcctgaatagcccctgtggtaagggccaggagagtccttccatcctccaaggccctgctaaaggacacagcagccaggaagtcccctgggcccctagctgaaggacagcctgctccctccgtctctaccaggaatggccttgtcctgtggaaggcactgccccatcccaaactaatctaggaatcactgtctaaccactcactgtcatgaatgtgtacttaaaggatgaggttgagtcataccaaatagtgatttcgatagttcaaaatggtgaaattagcaattctacatgattcagtctaatcaatggataccgactgtttcccacacaagtctcctgttctcttaagcttactcactgacagcctttcactctccacaaatacattaaagatatggccatcaccaagccccctaggatgacaccagacctgagagtctgaagacctggatccaagttctgacttttccccctgacagttgtgtgaccttcgtgaagtcgccaaacctctctgagccccagtcattgctagtaagacctgcctttgagttggtatgatgttcaagttagataacaaaatgtttatacccattagaacagagaataaatagaactacatttcttgca

SEQ ID NO: 180454 - DNA, 571 bp, Homo sapiens; identical to SEQ ID NO: 180443
  Payload ID: 15539
  Gene Symbol: SERPINA1
  Gene Name: serpin peptidase inhibitor, clade A (alpha-1 antiproteinase, antitrypsin), member 1
  ENST ID: ENST00000626480
  CDS Start-End: 221-571

SEQ ID NO: 180455 - DNA, 1628 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000627178
  CDS Start-End: 312-1568
atgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaa

SEQ ID NO: 180456 - DNA, 581 bp, Homo sapiens; identical to SEQ ID NO: 180448
  Payload ID: 15539
  Gene Symbol: SERPINA1
  Gene Name: serpin peptidase inhibitor, clade A (alpha-1 antiproteinase, antitrypsin), member 1
  ENST ID: ENST00000631256
  CDS Start-End: 304-581

SEQ ID NO: 180457 - DNA, 951 bp, Homo sapiens; identical to SEQ ID NO: 180447
  Payload ID: 15539
  Gene Symbol: SERPINA1
  Gene Name: serpin peptidase inhibitor, clade A (alpha-1 antiproteinase, antitrypsin), member 1
  ENST ID: ENST00000629092
  CDS Start-End: 518-951

SEQ ID NO: 180458 - DNA, 1450 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000625467
  CDS Start-End: 35-1114
ggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggtgagatcaccctgacgaccttgttgcaccctggtatctgtagggaagaatgtgtgggggctgcagctctgtcctgaggctgaggaaggggccgagggaaacaaatgaagacccaggctgagctcctgaagatgcccgtgattcactgacacgggacgtggtcaaacagcaaagccaggcaggggactgctgtgcagctggcactttcggggcctcccttgaggttgtgtcactgaccctgaatttcaactttgcccaagaccttctagacattgggccttgatttatccatactgacacagaaaggtttgggctaagttgtttcaaaggaatttctgactccttcgatct

SEQ ID NO: 180459 - DNA, 1885 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000627096
  CDS Start-End: 556-1812
gtgggcaggaactgggcactgtgcccagggcatgcactgcctccacgcagcaaccctcagagtcctgagctgaaccaagaaggaggagggggtcgggcctccgaggaaggcctagccgctgctgctgccaggaattccaggttggaggggcggcaacctcctgccagccttcaggccactctcctgtgcctgccagaagagacagagcttgaggagagcttgaggagagcaggaaagggcggcagtaagtcttcagcatcaggcattttggggtgactcagtaaatggtagatcttgctaccagtggaacagccactaaggattctgcagtgagagcagagggccagctaagtggtactctcccagagactgtctgactcacgccaccccctccaccttggacacaggacgctgtggtttctgagccaggtacaatgactcctttcgcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagc

SEQ ID NO: 180460 - DNA, 643 bp, Homo sapiens; identical to SEQ ID NO: 180446
  Payload ID: 15539
  Gene Symbol: SERPINA1
  Gene Name: serpin peptidase inhibitor, clade A (alpha-1 antiproteinase, antitrypsin), member 1
  ENST ID: ENST00000629711
  CDS Start-End: 175-643

SEQ ID NO: 180461 - DNA, 583 bp, Homo sapiens; identical to SEQ ID NO: 180445
  Payload ID: 15539
  Gene Symbol: SERPINA1
  Gene Name: serpin peptidase inhibitor, clade A (alpha-1 antiproteinase, antitrypsin), member 1
  ENST ID: ENST00000625866
  CDS Start-End: 517-583

SEQ ID NO: 180462 - DNA, 1622 bp, Homo sapiens
  Payload ID: 15539
  Gene Symbol: SERPINA1
  Gene Name: serpin peptidase inhibitor, clade A (alpha-1 antiproteinase, antitrypsin), member 1
  ENST ID: ENST00000628155
  CDS Start-End: 266-1522
aggtacaatgactcctttcggtaagtgcagtggaagctgtacactgcccaggcaaagcgtccgggcagcgtaggcgggcgactcagatcccagccagtggacttagcccctgtttgctcctccgataactggggtgaccttggttaatattcaccagcagcctcccccgttgcccctctggatccactgcttaaatacggacgaggacagggccctgtctcctcagcttcaggcaccaccactgacctgggacagtgaatcgacaatgccgtcttctgtctcgtggggcatcctcctgctggcaggcctgtgctgcctggtccctgtctccctggctgaggatccccagggagatgctgcccagaagacagatacatcccaccatgatcaggatcacccaaccttcaacaagatcacccccaacctggctgagttcgccttcagcctataccgccagctggcacaccagtccaacagcaccaatatcttcttctccccagtgagcatcgctacagcctttgcaatgctctccctggggaccaaggctgacactcacgatgaaatcctggagggcctgaatttcaacctcacggagattccggaggctcagatccatgaaggcttccaggaactcctccgtaccctcaaccagccagacagccagctccagctgaccaccggcaatggcctgttcctcagcgagggcctgaagctagtggataagtttttggaggatgttaaaaagttgtaccactcagaagccttcactgtcaacttcggggacaccgaagaggccaagaaacagatcaacgattacgtggagaagggtactcaagggaaaattgtggatttggtcaaggagcttgacagagacacagtttttgctctggtgaattacatcttctttaaaggcaaatgggagagaccctttgaagtcaaggacaccgaggaagaggacttccacgtggaccaggcgaccaccgtgaaggtgcctatgatgaagcgtttaggcatgtttaacatccagcactgtaagaagctgtccagctgggtgctgctgatgaaatacctgggcaatgccaccgccatcttcttcctgcctgacgaggggaaactacagcacctggaaaatgaactcacccacgatatcatcaccaagttcctggaaaatgaagacagaaggtctgccagcttacatttacccaaactgtccattactggaacctatgatctgaagagcgtcctgggtcaactgggcatcactaaggtcttcagcaatggggctgacctctccggggtcacagaggaggcacccctgaagctctccaaggccgtgcataaggctgtgctgaccatcgacgagaaagggactgaagctgctggggccatgtttttagaggccatacccatgtctatcccccccgaggtcaagttcaacaaaccctttgtcttcttaatgattgaacaaaataccaagtctcccctcttcatgggaaaagtggtgaatcccacccaaaaataactgcctctcgctcctcaacccctcccctccatccctggccccctccctggatgacattaaagaagggttgagctggtccctgcctgcatgtgactgtaaa

SEQ ID NO: 180463 - DNA, 4978 bp, Homo sapiens
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENST ID: ENST00000261994
  CDS Start-End: 134-1468
gctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaagatgtttgtgcaatctgtctggtattttaagcttgtttctaagaaccttagttacttggctaaagactagctgggtagaatatcttttctctgttgctcacatattttcatttttaaaaagttgcagatgagaacactatgtcaagataaagcctttgggaggaacacatgtaaacattctccttgagtcatgtgcttctctctctttccttctctctggtgcaaaataagtgttttattttaatctattacggagtcatttcttgctgactgacatcagaagaaaatagctctaaccagtcctgatcacagcatctgcttccatggtgcatcaaatcgcttggcagaggcattggctgaatcacagatcatctagttcaataccttcattttacaaaggaaagaaagagggacccagaaacaggtccatattcttactttcatgggccctaggcacgtttaaccttgtagactcctccttccttcatgaagatatatatgttctatggctgcattggtagaaagatgaatatattcgtctttcaaagttgcatatctagcttcaaagttatatgtctagcatatggcaataagcaaaacaccttcatgggcccttacagtactgtcagccttgggcactgtgtcttctgcatctagtggataagtcataccttatataccagtgggaacaaaatacttgtccaaggtcttccagtgtggcaatggcagagtcagaagcctacctttcctgagtctagtctccaagccctttttactcttccttccatctaaaacatctgatggggaccaggtaaacagcatgcactacagctacccatgggggttaaacagaatataagcatgaactttgtcccagggtgaaaaggaaaatcgtaaatatccctgatcttccttaggcagttattttctgtcacagaaacagaaaagactatattcagagaatcctgaatagagctgatttacagtgtgaactatgttaactaaatgcctaattggatttctgtctgtctgctatctaatgtttaaaaaaacctaaaattcatttattgattagttgtttaatataattcagagtaatgtgaataggtaataatattaatatgcagtctaaatactgacttttcatcattccataacctggactgatgaaaagtcagtatttagactgcatattaataaaataaaattcattcctgtattcattccaagagtactaattgacacttatgaagggacaggcaattctaggccctagagggccaaagacagaggactaactctatctgacattcttaagtcaccttgtttgtgttcaattagtcagatttgtttgtggaaaaatagtagaaagaggaataaagtagcatccagtccaatttcccacttttaagagatgaaatctggaaaaataagtctgtgagagcacaatactcactgaaatcaatatggccaaacccagtaataaaaaggtacattattattgaaggattcatatagcatgcagataaaaaactcctgccttcttcccaccacatacactgcaaagcaacaacagcataataattgtatttaatatactactctttaaggtagaaaatggacctattctatattttaaatatactttttaatgttccctcacatttgctttaagaagttcctaagacactcagtttcagatttcccaagtacacaggcatgacagaaaaacgcagaccaataaaaaatgtaacttaccttacacaaatacatacacacaaattcagggtttccaaccgagcgggggaaatcttaacattgtagaagtcttcactatatatgtgtcgagtttttgtttttgtttttgtttttgttttgagacagagtcttgctctgtcacccaggctggagtgcagtggtgcgatctcagctcactgcaacctccacctcccgggttcgtgccattctcctgcctcagcctcccgagtagctgggactacaggcacctgccaccacgaccggctaattttttgtattttaagtagagatggggtttcactgtgttagtcaggatggtcttgatctcctgaccttgtgatctgcccgcctcggcctcccaaagtgctgggattacaggcatgagccaccacgcccggccaagtgtcgagtcttaaaaattgttcctacacagacacactcaaccacacgttctcacatatatatgctgtaacaactgagaacaggttactgacttaatctaattcattctatcttcattgtaaaacttccactccagctgaagagcctgtttcatttcaattcaaagatttctcatatatccactaattgtatggcaaaactgactcatctccagactaagatattcaagctcaggaagtcaaataatagaaatgattttttaaatgtgtaagaggttataaagaaaaactttatgtgctccttatttaacctctattaagtaaaatcctttatagacctatctccatttctgcagtaaaagtgagctctacagttagcttgtaaggctaactagtgaaattcctggacttgttcttaaaaatgcaagttttagtaattaacaaaatgatgatgaagatgtcccttttccctacaactacagatggagggagatttttctttgccatacaactagcttaaaggattaatttgataagttgttaaactgagaactttcacaaaagtatccatcttgtttttgatataaatggagatacatgtagttattcataactgtcagtaatttgctgtttatcctgtttctatatatctgtccttgagagtataattttaataaatatttcaaagattttaggaaa

SEQ ID NO: 180464 - DNA, 2451 bp, Homo sapiens
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENST ID: ENST00000393096
  CDS Start-End: 467-1801
ctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatatttttt

SEQ ID NO: 180465 - DNA, 2526 bp, Homo sapiens
  Payload ID: 15540
  Gene Symbol: SERPINA10
  Gene Name: serpin peptidase inhibitor, clade A (alpha-1 antiproteinase, antitrypsin), member 10
  ENST ID: ENST00000554723
  CDS Start-End: 420-1874
gagggctgtgtggctgagcagtgcaaagacctccatcctacactccacagggactgtacatacagattgggagctggagtggggtaagaggcgaattatagacacaaggggctcctctgcaggaaggaggccaagggaaagaggcttgaaaggcttgatatttcacccaccaccactcactgccggagtaagcaggtctccccttcccagggctgaggggaggcagggatgtgtgctgtcccagggctgagaagtggcaggtgagctggtgattccttactgcccaggttctgtctaggaaggtgcgtcctcaccatgctggatggtgtcctagtccaggagcaccccctgagctcctggcctagactccaaagggttgggtagatgagcaaagactttacaaagaccttaggcgatatatgtccaggagcacccaggaattactgggctaccactgcagactgcaggacaagctccaagaacaggaaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaa

SEQ ID NO: 180466 - DNA, 2000 bp, Homo sapiens
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENST ID: ENST00000554173
  CDS Start-End: 56-1390
cacaggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagg

SEQ ID NO: 180467 - DNA, 2526 bp, Homo sapiens; identical to SEQ ID NO: 180465
  Payload ID: 15540
  Gene Symbol: SERPINA10
  Gene Name: serpin peptidase inhibitor, clade A (alpha-1 antiproteinase, antitrypsin), member 10
  ENST ID: ENST00000616057
  CDS Start-End: 420-1874

SEQ ID NO: 180468 - DNA, 4973 bp, Homo sapiens
  Payload ID: 15540
  Gene Symbol: SERPINA10
  Gene Name: serpin peptidase inhibitor, clade A (alpha-1 antiproteinase, antitrypsin), member 10
  Uniprot ID: Q9UK55
  ENST ID: ENST00000614630
  CDS Start-End: 134-1468
gctgaaggttctgggctgcaaagctgaagctttggtttctgctctaaatgaaggacttttccaggacccaaggccacacactggaagtcttgcagctgaagggaggcactccttggcctccgcagccgatcacatgaaggtggtgccaagtctcctgctctccgtcctcctggcacaggtgtggctggtacccggcttggcccccagtcctcagtcgccagagaccccagcccctcagaaccagaccagcagggtagtgcaggctcccaaggaggaagaggaagatgagcaggaggccagcgaggagaaggccagtgaggaagagaaagcctggctgatggccagcaggcagcagcttgccaaggagacttcaaacttcggattcagcctgctgcgaaagatctccatgaggcacgatggcaacatggtcttctctccatttggcatgtccttggccatgacaggcttgatgctgggggccacagggccgactgaaacccagatcaagagagggctccacttgcaggccctgaagcccaccaagcccgggctcctgccttccctctttaagggactcagagagaccctctcccgcaacctggaactgggcctcacacaggggagttttgccttcatccacaaggattttgatgtcaaagagactttcttcaatttatccaagaggtattttgatacagagtgcgtgcctatgaattttcgcaatgcctcacaggccaaaaggctcatgaatcattacattaacaaagagactcgggggaaaattcccaaactgtttgatgagattaatcctgaaaccaaattaattcttgtggattacatcttgttcaaagggaaatggttgaccccatttgaccctgtcttcaccgaagtcgacactttccacctggacaagtacaagaccattaaggtgcccatgatgtacggtgcaggcaagtttgcctccacctttgacaagaattttcgttgtcatgtcctcaaactgccctaccaaggaaatgccaccatgctggtggtcctcatggagaaaatgggtgaccacctcgcccttgaagactacctgaccacagacttggtggagacatggctcagaaacatgaaaaccagaaacatggaagttttctttccgaagttcaagctagatcagaagtatgagatgcatgagctgcttaggcagatgggaatcagaagaatcttctcaccctttgctgaccttagtgaactctcagctactggaagaaatctccaagtatccagggttttacaaagaacagtgattgaagttgatgaaaggggcactgaggcagtggcaggaatcttgtcagaaattactgcttattccatgcctcctgtcatcaaagtggaccggccatttcatttcatgatctatgaagaaacctctggaatgcttctgtttctgggcagggtggtgaatccgactctcctataattcaggacacgcataagcacttcgtgctgtagtagatgctgaatctgaggtatcaaacacacacaggataccagcaatggatggcaggggagagtgttccttttgttcttaactagtttagggtgttctcaaataaatacagtagtccccacttatctgagggggatacattcaaagacccccagcagatgcctgaaacggtggacagtgctgaaccttatatatattttttcctacacatacatacctatgataaagtttaatttataaattaggcacagtaagagattaacaataataacaacattaagtaaaatgagttacttgaatgcaagcactgcaataccataacagtcaaactgattatagagaaggctactaagtgactcatgggcgaggagcatagacagtgtggagacattgggcaaggggagaattcacatcctgggtgggacagagcaggacaatgcaagattccatcccactactcagaatggcatgctgcttaagacttttagattgtttatttctggaatttttcatttaatgtttttggaccatggttgaccatggttaactgagactgcagaaagcaaaaccatggataagggaggactactacaaaagcattaaattgatacatattttttaagatgtttgtgcaatctgtctggtattttaagcttgtttctaagaaccttagttacttggctaaagactagctgggtagaatatcttttctctgttgctcacatattttcatttttaaaaagttgcagatgagaacactatgtcaagataaagcctttgggaggaacacatgtaaacattctccttgagtcatgtgcttctctctctttccttctctctggtgcaaaataagtgttttattttaatctattacggagtcatttcttgctgactgacatcagaagaaaatagctctaaccagtcctgatcacagcatctgcttccatggtgcatcaaatcgcttggcagaggcattggctgaatcacagatcatctagttcaataccttcattttacaaaggaaagaaagagggacccagaaacaggtccatattcttactttcatgggccctaggcacgtttaaccttgtagactcctccttccttcatgaagatatatatgttctatggctgcattggtagaaagatgaatatattcgtctttcaaagttgcatatctagcttcaaagttatatgtctagcatatggcaataagcaaaacaccttcatgggcccttacagtactgtcagccttgggcactgtgtcttctgcatctagtggataagtcataccttatataccagtgggaacaaaatacttgtccaaggtcttccagtgtggcaatggcagagtcagaagcctacctttcctgagtctagtctccaagccctttttactcttccttccatctaaaacatctgatggggaccaggtaaacagcatgcactacagctacccatgggggttaaacagaatataagcatgaactttgtcccagggtgaaaaggaaaatcgtaaatatccctgatcttccttaggcagttattttctgtcacagaaacagaaaagactatattcagagaatcctgaatagagctgatttacagtgtgaactatgttaactaaatgcctaattggatttctgtctgtctgctatctaatgtttaaaaaaacctaaaattcatttattgattagttgtttaatataattcagagtaatgtgaataggtaataatattaatatgcagtctaaatactgacttttcatcattccataacctggactgatgaaaagtcagtatttagactgcatattaataaaataaaattcattcctgtattcattccaagagtactaattgacacttatgaagggacaggcaattctaggccctagagggccaaagacagaggactaactctatctgacattcttaagtcaccttgtttgtgttcaattagtcagatttgtttgtggaaaaatagtagaaagaggaataaagtagcatccagtccaatttcccacttttaagagatgaaatctggaaaaataagtctgtgagagcacaatactcactgaaatcaatatggccaaacccagtaataaaaaggtacattattattgaaggattcatatagcatgcagataaaaaactcctgccttcttcccaccacatacactgcaaagcaacaacagcataataattgtatttaatatactactctttaaggtagaaaatggacctattctatattttaaatatactttttaatgttccctcacatttgctttaagaagttcctaagacactcagtttcagatttcccaagtacacaggcatgacagaaaaacgcagaccaataaaaaatgtaacttaccttacacaaatacatacacacaaattcagggtttccaaccgagcgggggaaatcttaacattgtagaagtcttcactatatatgtgtcgagtttttgtttttgtttttgtttttgttttgagacagagtcttgctctgtcacccaggctggagtgcagtggtgcgatctcagctcactgcaacctccacctcccgggttcgtgccattctcctgcctcagcctcccgagtagctgggactacaggcacctgccaccacgaccggctaattttttgtattttaagtagagatggggtttcactgtgttagtcaggatggtcttgatctcctgaccttgtgatctgcccgcctcggcctcccaaagtgctgggattacaggcatgagccaccacgcccggccaagtgtcgagtcttaaaaattgttcctacacagacacactcaaccacacgttctcacatatatatgctgtaacaactgagaacaggttactgacttaatctaattcattctatcttcattgtaaaacttccactccagctgaagagcctgtttcatttcaattcaaagatttctcatatatccactaattgtatggcaaaactgactcatctccagactaagatattcaagctcaggaagtcaaataatagaaatgattttttaaatgtgtaagaggttataaagaaaaactttatgtgctccttatttaacctctattaagtaaaatcctttatagacctatctccatttctgcagtaaaagtgagctctacagttagcttgtaaggctaactagtgaaattcctggacttgttcttaaaaatgcaagttttagtaattaacaaaatgatgatgaagatgtcccttttccctacaactacagatggagggagatttttctttgccatacaactagcttaaaggattaatttgataagttgttaaactgagaactttcacaaaagtatccatcttgtttttgatataaatggagatacatgtagttattcataactgtcagtaatttgctgtttatcctgtttctatatatctgtccttgagagtataattttaataaatatttcaaagatttta

SEQ ID NO: 180469 - DNA, 1476 bp, Homo sapiens
  Payload ID: 15541
  Gene Symbol: SERPINA11
  Gene Name: serpin peptidase inhibitor, clade A (alpha-1 antiproteinase, antitrypsin), member 11
  Uniprot ID: Q86U17
  ENST ID: ENST00000334708
  CDS Start-End: 66-1334
ttcctgtgggtagaggtgatgcagtgctgaagacctgggcccctgctcagtgcctttgctctagaatgggtccagcttggctttggctactgggaacagggatcctggcctctgtccactgtcagccccttcttgcccatggagataaaagtctgcaggggcctcaaccccccaggcatcagctctcagagccagcccccgcctaccacagaatcacacccaccattaccaattttgctttgcgtttgtataaagagctggcagcagacgcccccggaaacatcttcttctcgccagtgagcatctccaccaccctggccctgctctctcttggggcccaagctaacacctcagctctgatcctggagggcctgggattcaacctcacagaaacccctgaagccgacatccaccagggcttccggagcctcctccacacccttgccctgcccagccccaaactcgaactaaaagtaggaaactccctgttcctagacaagcgactaaagcctcggcagcactatttggacagcatcaaggagctttatggagcttttgctttttctgccaacttcacagattctgttacaactgggaggcagattaatgactatttgagaaggcaaacatacgggcaagtcgtggactgcctcccggagttcagccaggacacgttcatggttcttgccaattacatcttcttcaaagccaagtggaagcaccctttcagtcgctaccagacccagaagcaggaaagtttctttgtggatgagaggacttctctccaggtccccatgatgcaccaaaaggaaatgcacagattcctctatgaccaggatttggcttgcaccgtcctccagatagaatacagaggaaatgccttggcgctgctggtcctccctgacccggggaaaatgaagcaggtggaggctgctctgcagccacagaccctgagaaaatggggccaattgctcctgcccagtctgttggatttgcacttgccaaggttttcaatttctggaacatataacctggaagacatacttccccaaattggtctcaccaacatactcaacttagaagctgacttctcaggagtcactgggcagctcaacaaaaccatctccaaggtgtcacacaaggcgatggtggacatgagtgagaaggggaccgaggccggggctgcttcaggcctcctctcccagcccccatctctgaacaccatgtcagacccacatgcccacttcaacaggcctttcctcttgctcctttgggaggtcaccacccagagcttactcttcctgggaaaagttgtcaacccagttgcagggtaaccatggtgggaggccaggagttatcttatctcatcctggaccaaacagataggccagaaccagcctgcatcctggggctgctatgtggttcagttaatcagtgtgccaagattctaataaagttgaccttgggttctgtgaa

SEQ ID NO: 180470 - DNA, 2061 bp, Homo sapiens
  Payload ID: 15542
  Gene Symbol: SERPINA12
  Gene Name: serpin peptidase inhibitor, clade A (alpha-1 antiproteinase, antitrypsin), member 12
  Uniprot ID: Q8IW75
  ENST ID: ENST00000341228
  CDS Start-End: 797-2041
ctcccaggtgcctggcagagagtcctcaccagccccctgccggatgtctggctggcatctgaggggactgaacatggcaagaagcaaaacagcagcacaagaaaccagtttcttcatctgaaaccgagcaggctctactccagaacagaacccacagtcccaggcgctgggccttcttcttaagttgggaaatcactcatccccaggagaaaaaaagagcaaaagcttccagtactggggatgtggggagaggttttttaaaaatatcagcccaacatatgggaaaatatgggatgcaggcatccccaggtgtcaagcgtccagatccgtagacacactgggacgatggtgatcagtatcactccctctgactcatcggccctacagggaagacaccatgctggtgcacagtcggtgccaaacccgcgtttgtaaatgaataagtgttgctgccctggtggaagcccagctcatgtggaggaagccagcttgcagagagagcaagaacagagccagcacacacattggagcaaaggcaagggcagatggaaagttctggcggcatcatgccaaggctcccatccgaggcctccctgaaccccactctctcggcgccaccttggatgctgcgggctggtacattccccacttgcaaaactctgtggggctgggttcctctcttttctttccaaatatcccaggaagtggatggttttatccaaattcagcagacgagtaaaaagagtcttcgggaggtgcaatagctttctaggaatgaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgcca

SEQ ID NO: 180471 - DNA, 1497 bp, Homo sapiens
  Payload ID: 15542
  Gene Symbol: SERPINA12
  Gene Name: serpin peptidase inhibitor, clade A (alpha-1 antiproteinase, antitrypsin), member 12
  Uniprot ID: Q8IW75
  ENST ID: ENST00000556881
  CDS Start-End: 224-1468
ggccttactcttccaagaggccatggaagtataaataataaagcaagaaaggcagatgcatttggctggctcagtggacttctgaatgtactgtgagtatgagaccttcccttccaaaagatccggtgcttcttgtctattccacacgaagcttgcttcagatcgagggaggatgtagcactgtccacaggtctactactcaacaggatattcttcaaggaaaatgaaccccacactaggcctggccatttttctggctgttctcctcacggtgaaaggtcttctaaagccgagcttctcaccaaggaattataaagctttgagcgaggtccaaggatggaagcaaaggatggcagccaaggagcttgcaaggcagaacatggacttaggctttaagctgctcaagaagctggccttttacaaccctggcaggaacatcttcctatcccccttgagcatctctacagctttctccatgctgtgcctgggtgcccaggacagcaccctggacgagatcaagcaggggttcaacttcagaaagatgccagaaaaagatcttcatgagggcttccattacatcatccacgagctgacccagaagacccaggacctcaaactgagcattgggaacacgctgttcattgaccagaggctgcagccacagcgtaagtttttggaagatgccaagaacttttacagtgccgaaaccatccttaccaactttcagaatttggaaatggctcagaagcagatcaatgactttatcagtcaaaaaacccatgggaaaattaacaacctgatcgagaatatagaccccggcactgtgatgcttcttgcaaattatattttctttcgagccaggtggaaacatgagtttgatccaaatgtaactaaagaggaagatttctttctggagaaaaacagttcagtcaaggtgcccatgatgttccgtagtggcatataccaagttggctatgacgataagctctcttgcaccatcctggaaataccctaccagaaaaatatcacagccatcttcatccttcctgatgagggcaagctgaagcacttggagaagggattgcaggtggacactttctccagatggaaaacattactgtcacgcagggtcgtagacgtgtctgtacccagactccacatgacgggcaccttcgacctgaagaagactctctcctacataggtgtctccaaaatctttgaggaacatggtgatctcaccaagatcgcccctcatcgcagcctgaaagtgggcgaggctgtgcacaaggctgagctgaagatggatgagaggggtacggaaggggccgctggcaccggagcacagactctgcccatggagacaccactcgtcgtcaagatagacaaaccctatctgctgctgatttacagcgagaaaataccttccgtgctcttcctgggaaagattgttaaccctattggaaaataaaggagaattcctgcttgccacagaccccg

SEQ ID NO: 180472 - DNA, 1485 bp, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENST ID: ENST00000616052
  CDS Start-End: 144-1409
agaacgccctactttaccagtgaggggatgatggggctggaagagggaaggaatgaaaggagtgtgaaggaagcgccaccaaggagagctgtggaagcccaacccaaagaccgcacctgggatgtcgggaagggccaaggacaatgccattctctgtctcatggggcatcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcacattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtctatcaatctacattttcccaaactgtccatttctggaacctacaaactcaagagagtccttaggaatctgggcatcaccaagatcttcagcaacgaggccgacctctctggagtcagtcaggaggcacccctgaagctctccaaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggatgacattaaagaaaggctgaattgc

SEQ ID NO: 180473 - DNA, 1266 bp, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENST ID: ENST00000613989
  CDS Start-End: 1-1266
atgccattctctgtctcatggggcatcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcacattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtctatcaatctacattttcccaaactgtccatttctggaacctacaaactcaagagagtccttaggaatctgggcatcaccaagatcttcagcaacgaggccgacctctctggagtcagtcaggaggcacccctgaagctctccaaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataa

SEQ ID NO: 180474 - DNA, 931 bp, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENST ID: ENST00000553483
  CDS Start-End: 1-931
ataccattctctgtctcatggggcgtcctcctgctggcaggcctgtgctgcctggtccccagctccctggttgaggatccccaggaagatgctgcccaaaagacggatacatcccaccatgatcaaggggactgggaggaccttgcttgccagaagatctcctataacgtcaccgacctcgcctttgatttgtacaaagagctggctgatctatcacaaaccagcaatgtcttagtcaccccaacaagcgtggctatggcctttgcaatgctctccctggggaccaaggctgacactcgcacagagatcctggaaggcctgaatgtcaacctcacagagacgcctgaggccaagatccacgaatgcttccagcaagttctccaagccctcagcaggccagacacccggctccagctgaccaccggcagtagcctgtttgttaacaagagtatgaagctagtggacacgtttttggaggataccaagaagctgtaccactcagaagcctcttccatcaacttcagggacaccgaggaggccaaagagcagatcaacaattatgtggagaaaagaactggaagaaaagtagtggatttggtcaaacacctgaaaaaagacacaagtcttgccctggtggattacatttcctttcacggcaagtggaaagataaattcaaggctgagcgcattatggtagagggcttccatgtggatgataagaccatcatcagagtgcctatgataaaccacctgggtagatttgacatccaccgggacagggagttatccagctgggtgctggcacagcactatgtggggaacgccactgccttcttcatcctgcccgatccaaagaagatgtggcagttggaagaaaaattgacctacagccaccttgaaaatatccagagagcctttgacataaggtgat

SEQ ID NO: 180475 - DNA, 474 bp, Homo sapiens
  Payload ID: 15543
  Gene Symbol: SERPINA2
  Gene Name: serpin peptidase inhibitor, clade A (alpha-1 antiproteinase, antitrypsin), member 2 (gene/pseudogene)
  ENST ID: ENST00000627359
  CDS Start-End: 1-195
gtcaaacacctgaaaaaagacacaagtcttgccctggtggattacatttcctttcacggtctatcaatctacattttcccaaactgtccatttctggaacctacaaactcaagagagtccttaggaatctgggcatcaccaagatcttcagcaacgaggccgacctctctggagtcagtcaggaggcacccctgaagctctccaaggctgtgcatgtggctgtgctcaccattgatgagaaagggaccgaagccaccggagccccccatctggaggagaaggcctggtctaagtatcagacagtcatgttcaaccggcccttcctggtcatcatcaaggatgacatcaccaactttccgctcttcattggaaaagtggtgaatcccacccaaaaataactggctgtcactcctcagcccctcccctccacccctggccccctccctggatgacattaaagaaaggctgaattgc

SEQ ID NO: 180476 - DNA, 1581 bp, Homo sapiens
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENST ID: ENST00000393080
  CDS Start-End: 69-1340
aaaatccactactccagacagacggctttggaatccaccagctacatccagctccctgagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggaca

SEQ ID NO: 180477 - DNA, 2660 bp, Homo sapiens
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENST ID: ENST00000467132
  CDS Start-End: 1149-2420
actactccagacagacggctttggaatccaccagctacatccagctccctgaggactgagtgggcggaggctgaaggtgaataatcttgtttgctgcggtcaccggcttggaactcagcccttccagggtctcttgtgcagtagctcatggctcttctctggcttgtagtttcaggaaaggggtagtatgggaggtggtgactgctcggtacgtctaatatgaaccaggtgccttcatcatttatctcacctgagccacttaacaggttgtgcagagacggaaacaggttgagagatgtacagtcacctgcttgccagtacacagcaatcaaaagtggccaaaataaaatcccagtccaagtctgggagactccaaagccctctctgccttctccccactaagaggcccttccaggcttatggtggacacagacaccacgtggcaacctggcaggggcagagaagaacatttgcctttctttggtcttgctgccaaccattatcagggccatcgaggctccagacactgtaccagggactttcatttccctctctcagtcgaccctcactgccacccagcatcacatcgtggaggcctgtggaggccacaccacgtgacatctagaggctgggagagtcactgtggcctctatctctgcccagggctccttcatccctgggttctactttggtggcagttgggagaatgaaggaagggagcccctgctttctaatcccctaggatgagatctgctcaccaagcaggagaggagcaggcattctgattggactgaacctcggaccccccatcagcttacagaccgaggagccaggcaaacctggctgcccactgggctcctttacctgtttgctgtatgatcttgggcaagccccctcaccgctctgtgcccggcttttccactgcaagaaaatggcaacaattatggtacctacctcaaagggtgaaatgaagcagagtgatgtgtgtcgggtgccccagagagcacctacctgagggaggctccaaagctagcaagaggcagcaggacagggaccaggacgcaggctgggtggagggcagtgggaggtggtcggggctccatctggccctctgagacttaaaggagctttgcttttcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggac

SEQ ID NO: 180478 - DNA, 2420 bp, Homo sapiens
  Payload ID: 15544
  Gene Symbol: SERPINA3
  Gene Name: serpin peptidase inhibitor, clade A (alpha-1 antiproteinase, antitrypsin), member 3
  ENST ID: ENST00000482740
  CDS Start-End: 1565-2182
aagttgacctgggcccatttgaaaattccttttgctccctcattttaacccctaaagtaaagccgtttgtgactttatgagcttttaccaagcatctcctaaaaccaagaatggaggtgaaagattgtggagcccacaacctagagaaaggattgacaattttttttccataaagggcctagtagtatgtattttaggctgtgtggtccacatgagggcagattcttctttttgacttcctcctctgcatcttcttcatcttctctttcctcttcattttttttacaacctttgaaaaatataagcaccattcttagctttaggtacacacaaaaataagctatggctgtattggcttacaggctatagtttcctgacccctgttctaggggaggaaaataattgtacccaactaaatgcgtgcgaatcatgggcctatgtcatgattcccaaagaatgagtttcatggaattttcaacattttaaatattttactccattcttcccttgcttgcatagtttctgatgagaagtctgctgtcattttcatccttattcctttttagataaggtggagttttcctccctctgcctctacctctacctctttcaagattttctctttctctttactatggtaaataggcctttagtgagaggagttatgtcagcctggctaggagtcaggctgcatttcaggtttgtgatagctagaggtaccagaggcagtttcatggaattttacctttgcaacactgagagcctaggcagcctcagagtcagaacacccacagttgaatcctcagcctgacagacactgaatccagggcaaatcttagctgaatattcatggtctgtagaggtggacatgagctagatatgagctaaggaccatagccagctcatggcttttgtgatgtccaacaccgctatcctctaagatgtcacaagtgtccctaggcttttattcccatggtctctcctggctctgagttctatcttccattaaggttcttcctgttcctcccctcattcacactgattggcatctcttctgtctgccctcaccaactcacatacagaacccagtctctttcctcttatttccacccaaagccctcccacaagccactgttatatgttcacatccctgtaataccagtgagtaataattgctaatgagacatttttccttttatggaacaaaggctgtcccatttctcctcaggcaccagcctcccacatgttgtcatgcctctttcccccactttccctaaaccttctttctctcttgcactccttattccctggttcctattgatttctcatttagcacaaggaactaggtctttcttttgtggcccttttcccaatccaagcctgctgggctctccctcacccccaataacttttactcttgccaagctacttctctaaaccaaagcagggtccctcctatgagggactctgggcacttccactgctgcggaagcagggtcgagcagggcgacccttgcactcacaccttctccaactgcttgctccaccttcagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgg

SEQ ID NO: 180479 - DNA, 981 bp, Homo sapiens
  Payload ID: 15544
  Gene Symbol: SERPINA3
  Gene Name: serpin peptidase inhibitor, clade A (alpha-1 antiproteinase, antitrypsin), member 3
  ENST ID: ENST00000555820
  CDS Start-End: 65-981
cactactccagacagacggctttggaatccaccagctacatccagctccctgaggcagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcag

SEQ ID NO: 180480 - DNA, 1289 bp, Homo sapiens
  Payload ID: 15544
  Gene Symbol: SERPINA3
  Gene Name: serpin peptidase inhibitor, clade A (alpha-1 antiproteinase, antitrypsin), member 3
  Uniprot ID: P01011
  ENST ID: ENST00000556968
  CDS Start-End: 52-702
acggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggac

SEQ ID NO: 180481 - DNA, 639 bp, Homo sapiens
  Payload ID: 15544
  Gene Symbol: SERPINA3
  Gene Name: serpin peptidase inhibitor, clade A (alpha-1 antiproteinase, antitrypsin), member 3
  ENST ID: ENST00000621603
  CDS Start-End: 1-140
gcaccgtggtggagctgaagtacacaggcaatgccagcgcactcttcatcctccctgatcaagacaagatggaggaagtggaagccatgctgctcccagagaccctgaagcggtggagagactctctggagttcaggtgattcttcctggcccccaaagaccccacatctctccacgtcaaggtctcaccaatgtccagggacaagggcatggtggtgggagaactcatacagggacaggtggaatttacacttactttgccctatgctgcctacatggctttgggcttgatttttctttttcttctttaagacaatgacatcagacaggacaaggggctgaggcttcctctgactccagcatgttctaagtcatgagaaatcttctgcacagtcccaaacactcatgcatggtttctcctggtctcaatctcttgaagggagagagaaacagaaggaattgtgatcagttgagggctgcagtgagatggactctgagaatcagttctgcactggtgaaccactgtatttattcattctctcagcatttgctgcatgattaattgagcacctactatgtgtcagacactaatttgcaccctgagagtaaatcagcaaataaaacacaagattccctgcc

SEQ ID NO: 180482 - DNA, 1589 bp, Homo sapiens
  Payload ID: 15545
  Gene Symbol:
  Gene Name: serpin peptidase inhibitor, clade A (alpha-1 antiproteinase, antitrypsin), member 3 [Source:EntrezGene
  Acc:12]
  ENST ID: ENST00000393078
  CDS Start-End: 80-1351
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttgg

SEQ ID NO: 180483 - DNA, 3067 bp, Homo sapiens
  Payload ID: 15545
  Gene Symbol:
  Gene Name: serpin peptidase inhibitor, clade A (alpha-1 antiproteinase, antitrypsin), member 3 [Source:EntrezGene
  Acc:12]
  ENST ID: ENST00000553947
  CDS Start-End: 1-137
tggtgcacaaagctgtggtggaggtggacgagtcgggaaccagagcagcggcagccacggggacaatattcactttcagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcatctaaatggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtaggacagctggtgaaacccaaaggaagaacctgtgtcaggacccccagagcggtgtctccactaagcagaagtctctgtttctctcctggcctctcccagaggggctgctctgaagcatgtggatttgatcaggataatcaagtccgagaacagaacacttggttgtcctggcatttcccaagcagggggaggagttctctgcaggaataaataagcctcagcattcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgaggagaatctgacccaggagaaccaagaccgagggacacacgtggacctcggattagcctccgccaacgtggacttcgctttcagcctgtacaagcagttagtcctgaaggcccctgataagaatgtcatcttctccccactgagcatctccaccgccttggccttcctgtctctgggggcccataataccaccctgacagagattctcaaaggcctcaagttcaacctcacggagacttctgaggcagaaattcaccagagcttccagcacctcctgcgcaccctcaatcagtccagcgatgagctgcagctgagtatgggaaatgccatgtttgtcaaagagcaactcagtctgctggacaggttcacggaggatgccaagaggctgtatggctccgaggcctttgccactgactttcaggactcagctgcagctaagaagctcatcaacgactacgtgaagaatggaactagggggaaaatcacagatctgatcaaggaccttgactcgcagacaatgatggtcctggtgaattacatcttctttaaagccaaatgggagatgccctttgacccccaagatactcatcagtcaaggttctacttgagcaagaaaaagtgggtaatggtgcccatgatgagtttgcatcacctgactataccttacttccgggacgaggagctgtcctgcaccgtggtggagctgaagtacacaggcaatgccagcgcactcttcatcctccctgatcaagacaagatggaggaagtggaagccatgctgctcccagagaccctgaagcggtggagagactctctggagttcagagagataggtgagctctacctgccaaagttttccatctcgagggactataacctgaacgacatacttctccagctgggcattgaggaagccttcaccagcaaggctgacctgtcagggatcacaggggccaggaacctagcagtctcccaggtggtccataaggctgtgcttgatgtatttgaggagggcacagaagcatctgctgccacagcagtcaaaatcaccctcctttctgcattagtggagacaaggaccattgtgcgtttcaacaggcccttcctgatgatcattgtccctacagacacccagaacatcttcttcatgagcaaagtcaccaatcccaagcaagcctagagcttgccatcaagcagtggggctctcagtaaggaacttggaatgcaagctggatgcctgggtctctgggcacagcctggcccctgtgcaccgagtggccatggcatgtgtggccctgtctgcttatccttggaaggtgacagcgattccctgtgtagctctcacatgcacaggggcccatggactcttcagtctggagggtcctgggcctcctgacagcaataaataatttcgttggacacgttgcttgtgcctttccatgctgactatcagactctgcgcccctgaggctacctgtgccccaaagacaagccccttgagctcccatgcaggctcagctccaccccaagatctgggctccttctgccttcagctgcagcagcctgcccaggactacctaagcttgtggccaagctcacccagacctcaggcccagggttgggaggggaccctgctgctctaaggccaattcctgccccccaggcttctgggtgcccactttcagtttctctccttccacccccagggcccaggctccacctggctctttccagagctcctagccctgaccacatctggcacagcccccggactccttgctcctgcagctgtgcagggctttatcatgcgacatccttcttctgccctttagcacccccaatttgggggaagtagctactttctgggtttccagatggagcccctcaactgcctcaccagttcctagccctggctctgtgaatgatctccctcaacaaccagaatgcagggctgaggacaaatgagccatcagcgcacaactgcaataaagcaatcgtgtagtcaggcattt

SEQ ID NO: 180484 - DNA, 1784 bp, Homo sapiens
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENST ID: ENST00000298841
  CDS Start-End: 226-1509
agagctgagacagccacccagggggtccactccaggacagactgtgccgtgagtaaccccctgagacaatggagacgagagactctagagggagggtgaccaactgttccactttgcccaagactgataattcttctgggatatattttcagtgctaaaaccaggaaagtcccaggcaagctgggacactttgtcactcttgctagaggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacag

SEQ ID NO: 180485 - DNA, 2012 bp, Homo sapiens
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENST ID: ENST00000557004
  CDS Start-End: 422-1705
ggagggaggtgggcgactgaagctcagagagggagtaaatgagctcaacttcacacagctagtgaggggctggttggagaccagattttccaagtggttccccgggccctcggggagcagcaagggccaggcgaacctccatgcactgcacaaacatgaagaagtgaaccctcttggggttccccaggtgggaagtggggtgtcttcttgggagggggtgaaccaacttctggtgagttttccttgttgaggcaatgctgcacccgtagcctgtttgttaataattacctggtcgggagagagtgggtggtactgagaaggcctggtttgaccagtcctcctgggcttgataagacagagctgagacagccacccagggggtccactccaggacagactgtgccgcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgcca

SEQ ID NO: 180486 - DNA, 1987 bp, Homo sapiens
  Payload ID: 15546
  Gene Symbol: SERPINA4
  Gene Name: serpin peptidase inhibitor, clade A (alpha-1 antiproteinase, antitrypsin), member 4
  Uniprot ID: P29622
  ENST ID: ENST00000555095
  CDS Start-End: 386-1669
aagacagagctgagacagccacccagggggtccactccaggacagactgtgccgtgagtaaccccctgagacaatggagacgagagactctagagggagggtgaccaactgttccactttgcccaagactgataattcttctgggatatattttcagtgctaaaaccaggaaagtcccaggcaagctgggacactttgtcactcttgctagaggtgagaaatactcaggctagaaaggccccgacttagggtccatgggcactggtgggtgactatgcccggagacccagaaaagcctcccccagggacacacagctggtacagggcggcactgactgagggccaaggtcttctggctgccaatccaggcctgagagtgcagaggatgcatcttatcgactacctgctcctcctgctggttggactactggccctttctcatggccagctgcacgttgagcatgatggtgagagttgcagtaacagctcccaccagcagattctggagacaggtgagggctcccccagcctcaagatagcccctgccaatgctgactttgccttccgcttctactacctgatcgcttcggagaccccggggaagaacatctttttctccccgctgagcatctcggcggcctacgccatgctttccctgggggcctgctcacacagccgcagccagatccttgagggcctgggcttcaacctcaccgagctgtctgagtccgatgtccataggggcttccagcacctcctgcacactctcaacctccccggccatgggctggaaacacgcgtgggcagtgctctgttcctgagccacaacctgaagttccttgcaaaattcctgaatgacaccatggccgtctatgaggctaaactcttccacaccaacttctacgacactgtgggcacaatccagcttatcaacgaccacgtcaagaaggaaactcgagggaagattgtggatttggtcagtgagctcaagaaggacgtcttgatggtgctggtgaattacatttacttcaaagccctgtgggagaaaccattcatttcctcaaggaccactcccaaagacttctatgttgatgagaacacaacagtccgggtgcccatgatgctgcaggaccaggagcatcactggtatcttcatgacagatacttgccctgctcggtgctacggatggattacaaaggagacgcaaccgtgtttttcattctccctaaccaaggcaaaatgagggagattgaagaggttctgactccagagatgctaatgaggtggaacaacttgttgcggaagaggaatttttacaagaagctagagttgcatcttcccaagttctccatttctggctcctatgtattagatcagattttgcccaggctgggcttcacggatctgttctccaagtgggctgacttatccggcatcaccaaacagcaaaaactggaggcatccaaaagtttccacaaggccaccttggacgtggatgaggctggcaccgaggctgcagcagccaccagcttcgcgatcaaattcttctctgcccagaccaatcgccacatcctgcgattcaaccggcccttccttgtggtgatcttttccaccagcacccagagtgtcctctttctgggcaaggtcgtcgaccccacgaaaccatagccctcccagggctgctcatctgttccaagcaggaggatgtggcaggggagggctgggagtgagtagctctgtgtttagagttggggacaaggatgacaccgaaggtccaggagtccaggacagcaggtgctggccggtggggagcggggaggggcactgagatgggcagggcctggacattccacaccctggtgctgtgcagcctctggcagagcatccgacctcttggagcaagtttctgcctctggaaagggggcgggcccttttcacaacaggctggttgtaccgagtaaacaacacgatgccatgaagaccctg

SEQ ID NO: 180487 - DNA, 2337 bp, Homo sapiens
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENST ID: ENST00000329597
  CDS Start-End: 236-1456
ggtggagacagggccggctgtggtcagtgacaaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactggt

SEQ ID NO: 180488 - DNA, 586 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000554220
  CDS Start-End: 71-586
aagacagagctgagacagccacccagggggtccactccaggacagactgtgccaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatc

SEQ ID NO: 180489 - DNA, 607 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000557598
  CDS Start-End: 137-607
acaatgcccaggacaagatcacaaagcatcatcctgttcaaaaggtcaacaggatcaaggttgagagaccctgaaataaggccatggggacaaaatgtcggctggataggaggtgctcaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacact

SEQ ID NO: 180490 - DNA, 829 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000556775
  CDS Start-End: 136-829
gacaaatgctggctgcaatccagccagccctctgccctttctgagcccgagggactgccacctccactgtgtgcacactcagctacgggacacatttcaggtatccaaggcagcagagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgc

SEQ ID NO: 180491 - DNA, 2071 bp, Homo sapiens
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENST ID: ENST00000553780
  CDS Start-End: 294-1514
aagacagagctgagacagccacccagggggtccactccaggacagactgtgcctgtgggctcacagggaagaggtcatgggcgaacagagtgaaggcaaccatctataagtgccagagagccctcaccagagaccaaccctgacggcaccttgaccttggatttccagcgtccagaactccacataattgggccccaaagccatgaagaaggaagaggaaatgtcttaaaggttgtcgatggacagtgtttgctgaacatcaaaatcactttccagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgta

SEQ ID NO: 180492 - DNA, 2211 bp, Homo sapiens
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENST ID: ENST00000554866
  CDS Start-End: 115-1335
agtgacaaatgctggctgcaatccagccagccctctgccctttctgagcccgagggactgccacctccactgtgtgcacactcagctacgggacacaaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaaca

SEQ ID NO: 180493 - DNA, 574 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000553511
  CDS Start-End: 303-574
ctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagat

SEQ ID NO: 180494 - DNA, 462 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000556064
  CDS Start-End: 390-462
aaaatgtcggctggataggaggtgctcagtaagtggcagcttctgttgttttctgtgcctggagtcttgggcctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaagaacaaagaacagccaccatgcagctcttcctcctcttgtgcctggtgcttctcagccctcagggggcctcccttcaccgccaccaccccc

SEQ ID NO: 180495 - DNA, 2210 bp, Homo sapiens
  Payload ID: 15547
  Gene Symbol: SERPINA5
  Gene Name: serpin peptidase inhibitor, clade A (alpha-1 antiproteinase, antitrypsin), member 5
  Uniprot ID: P05154
  ENST ID: ENST00000554276
  CDS Start-End: 114-1334
tttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaaca

SEQ ID NO: 180496 - DNA, 618 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000555681
  CDS Start-End: 186-618
acactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacacct

SEQ ID NO: 180497 - DNA, 533 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000554633
  CDS Start-End: 276-533
gtgcacactcagctacgggacacatttcaggtatccaaggcagcagaggtgagtgggtcccccgagctctgtgaccttatgctccacactaactctggcagagcctccgtttcctcatagggcaaggccagcagtgctgatggtcccaggcatgtagctggtctgagttcatagaaggaccacagcgccctgccatgtgccaaaccaggacaccagagtgaaggccagaagctcacatggaagcagcttagttccctgaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagc

SEQ ID NO: 180498 - DNA, 1113 bp, Homo sapiens
  Payload ID: 15547
  Gene Symbol: SERPINA5
  Gene Name: serpin peptidase inhibitor, clade A (alpha-1 antiproteinase, antitrypsin), member 5
  ENST ID: ENST00000554760
  CDS Start-End: 211-1113
agtgacaaatgctggctgcaatccagccagccctctgccctttctgagcccgagggactgccacctccactgtgtgcacactcagctacgggacacatttcaggtatccaaggcagcagaggtgagtgggtcccccgagctctgtgaccttatgctccacactaactctggcagagcctccgtttcctcatagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagact

SEQ ID NO: 180499 - DNA, 1534 bp, Homo sapiens
  Payload ID: 15548
  Gene Symbol: SERPINA6
  Gene Name: serpin peptidase inhibitor, clade A (alpha-1 antiproteinase, antitrypsin), member 6
  Uniprot ID: P08185
  ENST ID: ENST00000341584
  CDS Start-End: 148-1365
attaaccacccaggaagctggcaaacaaaatttaacaggcagcatccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggcacatggacacagccctttgacctggcaagcaccagggaggagaacttctatgtggacgagacaactgtggtgaaggtgcccatgatgttgcagtcgagcaccatcagttaccttcatgactcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctg

SEQ ID NO: 180500 - DNA, 1609 bp, Homo sapiens
  Payload ID: 15548
  Gene Symbol: SERPINA6
  Gene Name: serpin peptidase inhibitor, clade A (alpha-1 antiproteinase, antitrypsin), member 6
  ENST ID: ENST00000555056
  CDS Start-End: 73-909
gtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcctggagttgctggagtcattctcagcagacatcaagcactactatgagtcagaggtcttggctatgaatttccaggactgggcaacagccagcagacagatcaacagctatgtcaagaataagacacaggggaaaattgtcgacttgttttcagggctggatagcccagccatcctcgtcctggtcaactatatcttcttcaaaggtattcccacccatccccatctgaaggcccatccactatggccaggaataacagccgctaaaatccagggcacactcttgggcaaagtctttgattctgtaaagcacatacacatctgggaatctccatcttcaccacaatcctgctgggcacatggacacagccctttgacctggcaagcaccagggaggagaacttctatgtggacgagacaactgtggtgaaggtgcccatgatgttgcagtcgagcaccatcagttaccttcatgactcggagctcccctgccagctggtgcagatgaactacgtgggcaatgggactgtcttcttcatccttccggacaaggggaagatgaacacagtcatcgctgcactgagccgggacacgattaacaggtggtccgcaggcctgaccagcagccaggtggacctgtacattccaaaggtcaccatctctggagtctatgacctcggagatgtgctggaggaaatgggcattgcagacttgttcaccaaccaggcaaatttctcacgcatcacccaggacgcccagctgaagtcatcaaaggtggtccataaagctgtgctgcaactcaatgaggagggtgtggacacagctggctccactggggtcaccctaaacctgacgtccaagcctatcatcttgcgtttcaaccagcccttcatcatcatgatcttcgaccacttcacctggagcagccttttcctggcgagggttatgaacccagtgtaagagaccacccacccagagcctcagcactgtctgactttgggaaccagggatcccacagaaatgttttggagagcgggaggtttcccccaatctcctccaagttcttctccctccaaccagagttgtgtctaactttaggcatcttttaataaatgtcattgcgactctga

SEQ ID NO: 180501 - DNA, 719 bp, Homo sapiens
  Payload ID: 15548
  Gene Symbol: SERPINA6
  Gene Name: serpin peptidase inhibitor, clade A (alpha-1 antiproteinase, antitrypsin), member 6
  ENST ID: ENST00000557225
  CDS Start-End: 311-719
ccacccaggaagctggcaaacaaaatttaacaggcagcatccaccgcaggcttactgtacacatgctagggtccaggacagcaggaccaagccagcagaaacagcctgagcccaccgcagactatgaggaaactgaagtccagcgccctctgtgatgtgctccaggtcacacagccagtgtggaggaaggaactggggcttgaatggggtcttttgcctgcctcctcttgcactacgccccattgactcagagactgccacagcatctaacaagcttttctgatttggcagggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgtataagcacctagtggccttgagtcccaaaaagaacattttcatctcccctgtgagcatctccatggccttagctatgctgtccctgggcacctgtggccacacacgggcccagcttctccagggcctgggtttcaacctcactgagaggtctgagactgagatccaccagggtttccagcacctgcaccaactctttgcaaagtcagacaccagcttagaaatgaccatgggcaatgccttgtttcttgatggcagcc

SEQ ID NO: 180502 - DNA, 1534 bp, Homo sapiens; identical to SEQ ID NO: 180499
  Payload ID: 15548
  Gene Symbol: SERPINA6
  Gene Name: serpin peptidase inhibitor, clade A (alpha-1 antiproteinase, antitrypsin), member 6
  Uniprot ID: P08185
  ENST ID: ENST00000621384
  CDS Start-End: 148-1365

SEQ ID NO: 180503 - DNA, 1609 bp, Homo sapiens; identical to SEQ ID NO: 180500
  Payload ID: 15548
  Gene Symbol: SERPINA6
  Gene Name: serpin peptidase inhibitor, clade A (alpha-1 antiproteinase, antitrypsin), member 6
  ENST ID: ENST00000631236
  CDS Start-End: 73-909

SEQ ID NO: 180504 - DNA, 719 bp, Homo sapiens; identical to SEQ ID NO: 180501
  Payload ID: 15548
  Gene Symbol: SERPINA6
  Gene Name: serpin peptidase inhibitor, clade A (alpha-1 antiproteinase, antitrypsin), member 6
  ENST ID: ENST00000630843
  CDS Start-End: 311-719

SEQ ID NO: 180505 - DNA, 2642 bp, Homo sapiens
  Payload ID: 15549
  Gene Symbol: SERPINA7
  Gene Name: serpin peptidase inhibitor, clade A (alpha-1 antiproteinase, antitrypsin), member 7
  Uniprot ID: P05543
  ENST ID: ENST00000327674
  CDS Start-End: 337-1584
ttcagaaaaaaagtgattcaatttccataaatttaatttactcacagcgttttcataatgttgctataacatctgaatgacagtccatggcattatttccgtggttgcagcaagccacttctcctactccctgtccatattagatgcatctcctgtttttcaagggagagaaacccctgctcagcccctgatgagcacatcatcaaatatttactattgttttattaatcaatgtgggtggttattatgtgtctctggctcagggagtgtttcatccaactaagctccctcagtggttgtctcacttcatctcttatagattaacttccttccaaaatgtcaccattcctgtatctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttgaaaaattttcccttttctgtcttctggggaatagctaaaaagcaggtcaggtcttcgtatcccagtactccaataagatcaatggacataaaacaatgcagatgcattgtcttatatgtgaacttctcaacccccttcccactgtcccattagtaggattctctgagttcttgccagatctgacactggtaggttgaataaaggaactcccactatggggatgagttacagactgagacaactgaacaagttactgaacaagcatgggacaatacagcaagagataaacttgcctgtccaaccccaccttccccccaagaaaacatacttccaccttgccaatgtataagctgggagtggagaaagaaagtaattcattcatgtcatatctcatagaccctctttttctgtatcccaatcagactcctttccatatatagcacccctgtcccacttgtttaagtaggaatctcctttttggctctaatttcactgaatattggtacttttgtatccccagatccttcaacaaccttccctctacctgtacatgccaactcattaccacctaccaaactagattttatttcagacactatgtatttaaagcttgagtataaatggcacagtgagtggtaatgatgtagtatctgaaattctagccctgaggtaaaacacttcagtgacaggaaaatagtaaaaaaaatgcataagtactgttgcagatgttgtacttccatattgaaataaatatttatgtttag

SEQ ID NO: 180506 - DNA, 1600 bp, Homo sapiens
  Payload ID: 15549
  Gene Symbol: SERPINA7
  Gene Name: serpin peptidase inhibitor, clade A (alpha-1 antiproteinase, antitrypsin), member 7
  Uniprot ID: P05543
  ENST ID: ENST00000372563
  CDS Start-End: 59-1306
ttgctttctgagagatgcaggtggattcttgggcatttgctattaacttccttccaaaatgtcaccattcctgtatctggttctcttggtacttgggcttcatgctacaatccactgtgcatcacctgaaggcaaagtaacagcctgccattcatcccaaccaaatgccactctctacaagatgtcatccattaatgctgactttgcattcaatctgtaccggaggttcactgtggagaccccagataagaacatcttcttttcccctgtgagcatttctgcagctttggttatgctttcctttggggcctgctgcagcacccaaactgagattgtggagaccttggggttcaacctcacagacactccaatggtagagatccagcatggcttccagcatctgatctgttcactgaattttccaaagaaggaactggaattgcagataggaaatgccctcttcattggcaagcatctgaaaccactggcaaagttcttgaatgatgtcaagaccctctatgagactgaagtcttttctaccgacttctccaacatttctgcagccaagcaggagattaacagtcatgtggagatgcaaaccaaagggaaagttgtgggtctaattcaagacctcaagccaaacaccatcatggtcttagtgaactatattcactttaaagcccagtgggcaaatccttttgatccatccaagacagaagacagttccagcttcttaatagacaagaccaccactgttcaagtgcccatgatgcaccagatggaacaatactatcacctagtggatatggaattgaactgcacagttctgcaaatggactacagcaagaatgctctggcactctttgttcttcccaaggagggacagatggagtcagtggaagctgccatgtcatctaaaacactgaagaagtggaaccgcttactacagaagggatgggttgacttgtttgttccaaagttttccatttctgccacatatgaccttggagccacacttttgaagatgggcattcagcatgcctattctgaaaatgctgatttttctggactcacagaggacaatggtctgaaactttccaatgctgcccataaggctgtgctgcacattggtgaaaagggaactgaagctgcagctgtccctgaagttgaactttcggatcagcctgaaaacactttcctacaccctattatccaaattgatagatctttcatgttgttgattttggagagaagcacaaggagtattctctttctagggaaagttgtgaacccaacggaagcgtagttgggaaaaaggccattggctaattgcacgtgtgtattgcaatgggaaataaataaataatatagcctggtgtgattgatgtgagcttggacttgcattcccttatgatgggatgaagattgaaccctggctgaactttgttggctgtggaagaggccaatcctatggcagagcattcagaatgtcaatgagtaattcattattatccaaagcataggaaggctctatgtttgtatatttctctttgtcagaatacccctcaactcatttgctctaataaatttgactgggttg

SEQ ID NO: 180507 - DNA, 1423 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000298845
  CDS Start-End: 40-1047
agctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaacaga

SEQ ID NO: 180508 - DNA, 1755 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000337425
  CDS Start-End: 76-1383
cagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaa

SEQ ID NO: 180509 - DNA, 1333 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000380365
  CDS Start-End: 80-1333
tctgggtcacatttttgtggatacagaagccaggctggagtggaccagtgagtgagttggagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctag

SEQ ID NO: 180510 - DNA, 1462 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000424550
  CDS Start-End: 226-1086
tggagggagaggagagattaaagtgaggagagagctacaaccaagtaagcaagtgtcagggctcaccaaccatgcaaggacagggcaggagaagaggaacctgcaaagtccatgaagcagaaacatcaaaaagcatgggatttggaatttgagacctgactttgaagcccacacagaacacagacaagtcaaccatgctatttgggcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaacaga

SEQ ID NO: 180511 - DNA, 1520 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000448305
  CDS Start-End: 131-1144
taagcaagtgtcagggctcaccaaccatgcaaggacagggcaggagaagaggaacctgcaaaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagcaacccacaaggctgtgctggatgtcagtgaagagggcactgaggccacagcagctaccaccaccaagttcatagtccgatcgaaggatggcccctcttacttcactgtctccttcaataggaccttcctgatgatgattacaaataaagccacagacggtattctctttctagggaaagtggaaaatcccactaaatcctaggtgggaaatggcctgttaactgatggcacattgctaatgcacaagaaataacaaaccacatccctctttctgttctgagggtgcatttgaccccagtggagctggattcgctggcagggatgccacttccaaggctcaatcaccaaaccatcaacagggaccccagtcacaagccaacacccattaaccccagtcagtgcccttttccacaaattctcccaggtaactagcttcatgggatgttgctgggttaccatatttccattccttggggctcccaggaatggaaatacgccaacccaggttaggcacctctattgcagaattacaataacacattcaataaaactaaaatatgaattcatctgtcaacaga

SEQ ID NO: 180512 - DNA, 1346 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000538527
  CDS Start-End: 80-685
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaagacatattttgttccaaaatggcatcttacctttatggagtactctttgctgttggcctctgtgctccaatctactgtgtgtccccggccaatgcccccagtgcatacccccgcccttcctccacaaagagcacccctgcctcacaggtgtattccctcaacaccgactttgccttccgcctataccgcaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttgaatgaaaatatttgcaaaaaagtccaagctggaagcacctgcagaattaatcacatgctcttatttcgttgat

SEQ ID NO: 180513 - DNA, 1156 bp, Homo sapiens
  Payload ID: 15550
  Gene Symbol: SERPINA9
  Gene Name: serpin peptidase inhibitor, clade A (alpha-1 antiproteinase, antitrypsin), member 9
  Uniprot ID: Q86WD7
  ENST ID: ENST00000546329
  CDS Start-End: 80-1084
atcatttgcatgtctagctggagaataaaaataatatatcatttgcatgtcttagtaatgaagtcatgggtgtcgtggcatgagatcagctggagggagaggagagattaaagtgaggagagagctacaaccaagtaagcaagtgtcagggctcaccaaccatgcaaggacagggcaggagaagaggaacctgcaaaggctggttttggagaccccgagtcagaacatcttcttctcccctgtgagtgtctccacttccctggccatgctctcccttggggcccactcagtcaccaagacccagattctccagggcctgggcttcaacctcacacacacaccagagtctgccatccaccagggcttccagcacctggttcactcactgactgttcccagcaaagacctgaccttgaagatgggaagtgccctcttcgtcaagaaggagctgcagctgcaggcaaatttcttgggcaatgtcaagaggctgtatgaagcagaagtcttttctacagatttctccaacccctccattgcccaggcgaggatcaacagccatgtgaaaaagaagacccaagggaaggttgtagacataatccaaggccttgaccttctgacggccatggttctggtgaaccacattttctttaaagccaagtgggagaagccctttcaccctgaatatacaagaaagaacttcccattcctggtgggcgagcaggtcactgtgcatgtccccatgatgcaccagaaagagcagttcgcttttggggtggatacagagctgaactgctttgtgctgcagatggattacaagggagatgccgtggccttctttgtcctccctagcaagggcaagatgaggcaactggaacaggccttgtcagccagaacactgagaaagtggagccactcactccagaaaaggtggatagaggtgttcatccccagattttccatttctgcctcctacaatctggaaaccatcctcccgaagatgggcatccaaaatgtctttgacaaaaatgctgatttttctggaattgcaaagagagactccctgcaggtttctaaagtgagttgaatgaaaatatttgcaaaaaagtccaagctggaagcacctgcagaattaatcacatgctcttatttcgttgat

SEQ ID NO: 180514 - DNA, 2619 bp, Homo sapiens
  Payload ID: 15551
  Gene Symbol: SERPINB1
  Gene Name: serpin peptidase inhibitor, clade B (ovalbumin), member 1
  Uniprot ID: P30740
  ENST ID: ENST00000380739
  CDS Start-End: 204-1343
cgctcacttctgcttgcacttaggcgacctcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcaccatggagcagctgagctcagcaaacacccgcttcgccttggacctgttcctggcgttgagtgagaacaatccggctggaaacatcttcatctctcccttcagcatttcatctgctatggccatggtttttctggggaccagaggtaacacggcagcacagctgtccaagactttccatttcaacacggttgaagaggttcattcaagattccagagtctgaatgctgatatcaacaaacgtggagcgtcttatattctgaaacttgctaatagattatatggagagaaaacttacaatttccttcctgagttcttggtttcgactcagaaaacatatggtgctgacctggccagtgtggattttcagcatgcctctgaagatgcaaggaagaccataaaccagtgggtcaaaggacagacagaaggaaaaattccggaactgttggcttcgggcatggttgataacatgaccaaacttgtgctagtaaatgccatctatttcaagggaaactggaaggataaattcatgaaagaagccacgacgaatgcaccattcagattgaataagaaagacagaaaaactgtgaaaatgatgtatcagaagaaaaaatttgcatatggctacatcgaggaccttaagtgccgtgtgctggaactgccttaccaaggcgaggagctcagcatggtcatcctgctgccggatgacattgaggacgagtccacgggcctgaagaagattgaggaacagttgactttggaaaagttgcatgagtggactaaacctgagaatctcgatttcattgaagttaatgtcagcttgcccaggttcaaactggaagagagttacactctcaactccgacctcgcccgcctaggtgtgcaggatctctttaacagtagcaaggctgatctgtctggcatgtcaggagccagagatatttttatatcaaaaattgtccacaagtcatttgtggaagtgaatgaagagggaacagaggcggcagctgccacagcaggcatcgcaactttctgcatgttgatgcccgaagaaaatttcactgccgaccatccattccttttctttattcggcataattcctcaggtagcatcctattcttggggagattttcttccccttagaagaaagagactgtagcaatacaaaaatcaagcttagtgctttattacctgagtttttaatagagccaatatgtcttatatctttaccaataaaaccactgttcagaaacaagtctttcattttctttgtaagtttggctctgttggctgtttacacccatgaattttggcatgggtatctatttttcttttttacattgaaaaaaatccagtggttgcttttgaatgcatcaagtaaagaagaagaaaagaatacatccgatgcgtagattcttgaccatgtagtaatctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcaccccaattgagagcccaggttacgaagacaagcttgcctcgcctgacttttctgtcccttgttctgcaggattagtattctgttacagacctctagtttttagactcttcaattaaagggccaatggttataacctgcattcccttttttgttcttctttatgtataatatatagttcatgtggcgctgcatgaaatcaagaagtgggtgtcttaggataaaagataccaagagtctacaaaaataaccatgtagtaagataaactgctgaacaaaggttttactgttagccaccttctcatgtgttttcttttctctttttctttttctttctttctttcttttttttttttttgagacagagtcttgctctgttacccaggctggagtgcagtggcacgatctcagctcaccgcaacctctgcctcctgggttcaagtgattctcttgcttcagcctcctgagtagctgggattataggcatgcaccactaggcctggctaatttttgtatttttagtagagatggggtttttccatgttggccaggctggtcccgaactcctgacctcaggtgatccgcgcacctcagcctcccaaagtgctgggattacaggcatgagctaccatgcctggccttctcatgtgttttctgattaaggctcttgacttccaaggctgtgtggggagatggggtgggggctcttggactgatataaaactttgtcaaatgtagttctttgaatggagcttgaaacgccgcatattcttgctcccacaaggatagtgggcatcatgaattaataaaacgtcctaggattctgcaagcta

SEQ ID NO: 180515 - DNA, 2122 bp, Homo sapiens
  Payload ID: 15552
  Gene Symbol: SERPINB10
  Gene Name: serpin peptidase inhibitor, clade B (ovalbumin), member 10
  Uniprot ID: P48595
  ENST ID: ENST00000238508
  CDS Start-End: 60-1253
tcttactacaggagcaaattgccaattctgctccagtgggagaaaacaaggtttcctcaatggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatgtgaccctgaaagtgaaaaaaaaaggaaaatggaattcaacttgagcaactcggaagaaatacactctgatttccaaacacttatctcagaaatcctcaagcccaacgatgactacttacttaaaacagccaatgcgatatatggagagaaaacgtatgcatttcacaataaatatttagaagacatgaaaacatattttggtgcagaacctcagcctgttaactttgtggaagcttctgatcaaatcagaaaggacatcaactcttgggttgaaagacagaccgagggtaaaatccagaatctcctgcctgatgactctgtggattccacaaccaggatgattctggtgaacgccctatactttaaaggaatctgggaacatcaattcttagtgcaaaacaccacagaaaagccttttagaataaacgagactacaagcaaaccagtgcaaatgatgtttatgaagaaaaagcttcacatttttcacatagaaaagccaaaagcagtgggccttcaactctactacaaaagccgtgacctcagcctgcttatactactgccagaagacattaatgggctggaacagctggaaaaggccatcacctatgagaagctgaatgagtggaccagtgcagacatgatggagttgtatgaagtgcagctacaccttcccaagttcaagctggaagacagttatgatctcaagtcaaccctgagcagtatggggatgagtgatgccttcagccaaagcaaagctgatttctcaggaatgtcttcagcaagaaacctatttttgtccaatgttttccataaggcttttgtggaaataaatgaacaaggtactgaagctgcagctggcagtgggagtgagatagatatacgaattagagtcccatccattgaattcaatgcaaatcacccattcctcttcttcatcaggcacaataaaaccaacaccattcttttttatggaagattatgctccccctaaatcctgcatatctctcaacaaacaagaccatcttacagtgtgaaaaatgtaccatgagatggaaaagcacaattttcacaaaaatgagtttgtagtctaaacctttttcacatttgaatataagtaaatagatcttgaaataatgcattctaatgatcctgtcatatctgtacagctggagagaatgacgatttttatttttaacacgttaacattttgtctaatgtgactttcatttacatttcagaagtactatgctattcaactgaatgccttacaattcttgatcacttgcaatatccatgatacttgttatcatatatttcatatacatcattaaatgaaaaaaaatctttataaaggtgatatgatattgataaatacgaagtttctcaagaatatcgttttgatcaaaaatttagcccggcatggtggtgcacacctgtgttcccagctactcaggaggctgaggtaggaggattgcttgagcccaggaggttgagactgcagtgagccaagatcacaccagtgcactccaacctgggcaacagagcaagaccctgtctcaaaaaaatcattttggtggctcataaattatgattgtaaaactaaaccccctttttctgctatttaaaaaatacttatattgacattagcttaaaaaactagtgaaatccaaatgaaatttgaagtttagctagtagcaatctctcaatgttggtgccctagttttgacaaatgtaccgtggtcatgtaagatgttatcacttggggaaactgtactggagtatatgagaattagctgtattatctctgcacctcttctgccaatctaaaattattccaaaataaaagttttattaaaaata

SEQ ID NO: 180516 - DNA, 840 bp, Homo sapiens
  Payload ID: 15552
  Gene Symbol: SERPINB10
  Gene Name: serpin peptidase inhibitor, clade B (ovalbumin), member 10
  ENST ID: ENST00000397996
  CDS Start-End: 1-840
aagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgagttgaaagtttctcaactcttcagccacaatctcttactacaggagcaaattgccaattctgctccagtgggagaaaacaaggtttcctcaatggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatg

SEQ ID NO: 180517 - DNA, 759 bp, Homo sapiens
  Payload ID: 15552
  Gene Symbol: SERPINB10
  Gene Name: serpin peptidase inhibitor, clade B (ovalbumin), member 10
  ENST ID: ENST00000418725
  CDS Start-End: 1-759
aagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtttcctcaatggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatg

SEQ ID NO: 180518 - DNA, 1194 bp, Homo sapiens
  Payload ID: 15552
  Gene Symbol: SERPINB10
  Gene Name: serpin peptidase inhibitor, clade B (ovalbumin), member 10
  Uniprot ID: P48595
  ENST ID: ENST00000619595
  CDS Start-End: 1-1194
atggactctctagcaacatcaatcaaccagtttgccctggagttgagcaaaaagctagctgaatctgctcagggtaaaaatatcttcttttcttcctggagcatctcaacttccttgaccatagtgtatttgggcgccaaaggtaccactgcagcccaaatggcccaggtgcttcaatttaacagagaccagggagtcaaatgtgaccctgaaagtgaaaaaaaaaggaaaatggaattcaacttgagcaactcggaagaaatacactctgatttccaaacacttatctcagaaatcctcaagcccaacgatgactacttacttaaaacagccaatgcgatatatggagagaaaacgtatgcatttcacaataaatatttagaagacatgaaaacatattttggtgcagaacctcagcctgttaactttgtggaagcttctgatcaaatcagaaaggacatcaactcttgggttgaaagacagaccgagggtaaaatccagaatctcctgcctgatgactctgtggattccacaaccaggatgattctggtgaacgccctatactttaaaggaatctgggaacatcaattcttagtgcaaaacaccacagaaaagccttttagaataaacgagactacaagcaaaccagtgcaaatgatgtttatgaagaaaaagcttcacatttttcacatagaaaagccaaaagcagtgggccttcaactctactacaaaagccgtgacctcagcctgcttatactactgccagaagacattaatgggctggaacagctggaaaaggccatcacctatgagaagctgaatgagtggaccagtgcagacatgatggagttgtatgaagtgcagctacaccttcccaagttcaagctggaagacagttatgatctcaagtcaaccctgagcagtatggggatgagtgatgccttcagccaaagcaaagctgatttctcaggaatgtcttcagcaagaaacctatttttgtccaatgttttccataaggcttttgtggaaataaatgaacaaggtactgaagctgcagctggcagtgggagtgagatagatatacgaattagagtcccatccattgaattcaatgcaaatcacccattcctcttcttcatcaggcacaataaaaccaacaccattcttttttatggaagattatgctccccctaa

SEQ ID NO: 180519 - DNA, 1918 bp, Homo sapiens
  Payload ID: 15553
  Gene Symbol: SERPINB11
  Gene Name: serpin peptidase inhibitor, clade B (ovalbumin), member 11 (gene/pseudogene)
  Uniprot ID: Q96P15
  ENST ID: ENST00000382749
  CDS Start-End: 246-1424
ggtgcagggccgggcatggtcgttcacgcctgtaatcccagcactttaggaggctgaggcaggtggatcacgagggctgtactttccaaccagcaggtgaagagctgaatcactaagggcacaaatgaaaagggaggggcaaaatatgaaggctttatatttccttttgagggacgcagctccagtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaacgattaatgcttgggttgaaaataaaactaatggaaaagtcgcaaatctctttggaaagagcacaattgacccttcatctgtaatggtcctggtgaatgccatatatttcaaaggacaatggcaaaataaatttcaagtaagagagacagttaaaagtccttttcagctaagtgagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagatttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaataccttaaagctc

SEQ ID NO: 180520 - DNA, 1846 bp, Homo sapiens
  Payload ID: 15553
  Gene Symbol: SERPINB11
  Gene Name: serpin peptidase inhibitor, clade B (ovalbumin), member 11 (gene/pseudogene)
  ENST ID: ENST00000544088
  CDS Start-End: 174-1352
agggctgtactttccaaccagcaggtgaagagctgaatcactaagggcacaaatgaaaagggaggggcaaaatatgaaggctttatatttccttttgagggacgcagctccagtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaacgattaatgcttgggttgaaaataaaactaatggaaaagtcgcaaatctctttggaaagagcacaattgacccttcatctgtaatggtcctggtgaatgccatatatttcaaaggacaatggcaaaataaatttcaagtaagagagacagttaaaagtccttttcagctaagtgagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaaggctttgttaatcatggaaaaaggtagatttatgcagaaagcctttctggctttcttatctgtggtgtctcatttgagtgctgtccagtgacatgatcaagtcaatgagtaaaattttaagggattagattttcttgacttgtatgtatctgtgagatcttgaataagtgacctgacatctctgcttaaagaaaaccagctgaagggcttcaactttgcttggatttttaaatattttccttgcatatgtaaatagaatgtggtgagttttagttcaaaattctctgttgagaataataaatgcatgaaataccttaaagctc

SEQ ID NO: 180521 - DNA, 1294 bp, Homo sapiens
  Payload ID: 15553
  Gene Symbol: SERPINB11
  Gene Name: serpin peptidase inhibitor, clade B (ovalbumin), member 11 (gene/pseudogene)
  ENST ID: ENST00000536691
  CDS Start-End: 63-470
agtctaacttgccactctgtgaacttcactactggaaagcaacaaaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcaggaaaagtcgcaaatctctttggaaagagcacaattgacccttcatctgtaatggtcctggtgaatgccatatatttcaaaggacaatggcaaaataaatttcaagtaagagagacagttaaaagtccttttcagctaagtgagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaatcagatggggttgagcaaggctcagagttgcagatgaggtgcagagacaatcctgtgactttcccacggccaaaaagctgttcacacctcacacacctctgtgcctcagtttgctcatctgcaaaataggtctaggatttcttccaaccatttcatgagttgtgaagctaa

SEQ ID NO: 180522 - DNA, 1242 bp, Homo sapiens
  Payload ID: 15553
  Gene Symbol: SERPINB11
  Gene Name: serpin peptidase inhibitor, clade B (ovalbumin), member 11 (gene/pseudogene)
  ENST ID: ENST00000489748
  CDS Start-End: 700-1242
ggttttcatgagggaaaacaactccagtaaggtttgaaaagcagagagggaaatagtctcatatgtcacaaacagaattatatttcaaatttagaagatacggtattaagtgattcatcttattttggacatttttcctcaaggagaatttttctggaagaaaaagtacatttatatgtgggcttattaagagaaagagagaaaggcatgctattttaatcattaaattcttgatgatgacgatcatcatcaagatgagaaagaaaagaaatatgagccaagagaatctgttgttgccagcaatcagtttaccagaacatctgcaggtgaacattttccaaatggagtgacagactaattgcatctacggggatgagaatctgccatagaagaggatgctgttggtcttattttgccttatgaagaataggaaagggtgattacaatggaactcttcattagttgaagtaggtgatgatccgaatcctactacagcggtggcagctgcagcttctgctccctcctctgtaacctccacaaaggccttgtgtaggactccagatagcacgagaccgcggctcccggtcatgcctgagaggtctgcatccccattgaagatatccaccattcccatggttctcaacgtgtccttgaggtcatagctctcttccactttgaaccgaggcagtcggcataaaaatgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagcaatatttaagctgttctgagaaatggtatcaagccaggttgcaaactgtggattttgaacagtctacagaagaaacgaggaaaacgattaatgcttgggttgaaaataaaactaatggaaaagtcgcaaatctctttggaaagagcacaattgacccttcatctgtaatggtcctggtgaatgcc

SEQ ID NO: 180523 - DNA, 573 bp, Homo sapiens
  Payload ID: 15553
  Gene Symbol: SERPINB11
  Gene Name: serpin peptidase inhibitor, clade B (ovalbumin), member 11 (gene/pseudogene)
  ENST ID: ENST00000624518
  CDS Start-End: 1-573
atgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaa

SEQ ID NO: 180524 - DNA, 918 bp, Homo sapiens
  Payload ID: 15553
  Gene Symbol: SERPINB11
  Gene Name: serpin peptidase inhibitor, clade B (ovalbumin), member 11 (gene/pseudogene)
  ENST ID: ENST00000623262
  CDS Start-End: 1-918
atgggttctctcagcacagctaacgttgaattttgccttgatgtgttcaaagagctgaacagtaacaacataggagataacatcttcttttcttcgctgagtctgctttatgctctaagcatggtcctccttggtgccaggggagagactgaagagcaattggagaaggtgcttcattttagtcatactgtagactcattaaaaccagggttcaaggactcacctaagtgcagccaagctggaagaattcattccgagtttggtgtcgaattctctcaaatcaaccagccagactctaactgtaccctcagcattgccaacaggctctacgggacaaagacgatggcatttcatcagggtaaaaatgtaactgtggaaatgatgtatcaaattggaacatttaaactggcctttgtaaaggagccgcagatgcaagttcttgagctgccctacgttaacaacaaattaagcatgattattctgcttccagtaggcatagctaatctgaaacagatagaaaagcagctgaattcggggacgtttcatgagtggacaagctcttctaacatgatggaaagagaagttgaagtacacctcccccgattcaaacttgaaactaagtatgagctaaattccctgttaaaatctctaggggtgacagatctcttcaaccaggtcaaagctgatctttctggaatgtcaccaaccaagggcctatatttatcaaaagccatccacaagtcatacctggatgtcagcgaagagggcacggaggcagcagcagccactggggacagcatcgctgtaaaaagcctaccaatgagagctcagttcaaggcgaaccaccccttccttttctttataaggcacactcataccaacacgatcctattctgtggcaagcttgcctctccctaa

SEQ ID NO: 180525 - DNA, 1218 bp, Homo sapiens
  Payload ID: 15554
  Gene Symbol: SERPINB12
  Gene Name: serpin peptidase inhibitor, clade B (ovalbumin), member 12
  Uniprot ID: Q96P63
  ENST ID: ENST00000269491
  CDS Start-End: 1-1218
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 180526 - DNA, 1278 bp, Homo sapiens
  Payload ID: 15554
  Gene Symbol: SERPINB12
  Gene Name: serpin peptidase inhibitor, clade B (ovalbumin), member 12
  Uniprot ID: Q96P63
  ENST ID: ENST00000382768
  CDS Start-End: 1-1278
atggactctcttgttacagcaaacaccaaattttgctttgatctttttcaagagataggcaaagatgatcgtcataaaaacatatttttctctcccctgagcctctcagctgcccttggtatggtacgcttgggtgctagaagtgacagtgcacatcagattgatgaggtactacacttcaacgaattttcccagaatgaaagcaaagaacctgacccttgtctgaaaagcaacaaacaaaaagtgctggctgacagctctctggaggggcagaaaaaaacgacagagcctctggatcagcaggctgggtccttaaacaatgagagcggactggtcagctgctactttgggcagcttctctccaaattagacaggatcaagactgattacacactgagtattgccaacaggctttatggagagcaggaattcccaatctgtcaggaatacttagatggtgtgattcaattttaccacacgacgattgaaagtgttgatttccaaaaaaaccctgaaaaatccagacaagagattaacttctgggttgaatgtcaatcccaaggtaaaatcaaggaactcttcagcaaggacgctattaatgctgagactgtgctggtactggtgaatgctgtttacttcaaggccaaatgggaaacatactttgaccatgaaaacacggtggatgcacctttctgtctaaatgcgaatgaaaacaagagtgtgaagatgatgacgcaaaaaggcctctacagaattggcttcatagaggaggtgaaggcacagatcctggaaatgaggtacaccaaggggaagctcagcatgttcgtgctgctgccatctcactctaaagataacctgaagggtctggaagagcttgaaaggaaaatcacctatgaaaaaatggtggcctggagcagctcagaaaacatgtcagaagaatcggtggtcctgtccttcccccggttcaccctggaagacagctatgatctcaattccattttacaagacatgggcattacggatatctttgatgaaacgagggctgatcttactggaatctctccaagtcccaatttgtacttgtcaaaaattatccacaaaacctttgtggaggtggatgaaaacggtacccaggcagctgcagccactggggctgttgtctcggaaaggtcactacgatcttgggtggagtttaatgccaaccacccttttctctttttcattagacacaacaaaacccaaaccattctcttttatggcagggtctgctctccttaa

SEQ ID NO: 180527 - DNA, 3206 bp, Homo sapiens
  Payload ID: 15555
  Gene Symbol: SERPINB13
  Gene Name: serpin peptidase inhibitor, clade B (ovalbumin), member 13
  ENST ID: ENST00000269489
  CDS Start-End: 169-1371
aaagttccaaggagattttaaggtgcacgcaaggtggaaaaccactgctgaagcagatgtggagaactataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcat

SEQ ID NO: 180528 - DNA, 3114 bp, Homo sapiens
  Payload ID: 15555
  Gene Symbol: SERPINB13
  Gene Name: serpin peptidase inhibitor, clade B (ovalbumin), member 13
  Uniprot ID: Q9UIV8
  ENST ID: ENST00000344731
  CDS Start-End: 103-1278
ctataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcata

SEQ ID NO: 180529 - DNA, 580 bp, Homo sapiens
  Payload ID: 15555
  Gene Symbol: SERPINB13
  Gene Name: serpin peptidase inhibitor, clade B (ovalbumin), member 13
  ENST ID: ENST00000431153
  CDS Start-End: 106-580
ttcttttttcttgttcctttgtagcaagatagttttctttcattttcttcctggcatttggcactcctaaataatgcaaatgcaaaaataactctgttacagagaatgacttgtcaggacacagctctgtccatctgtgttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatc

SEQ ID NO: 180530 - DNA, 1018 bp, Homo sapiens
  Payload ID: 15555
  Gene Symbol: SERPINB13
  Gene Name: serpin peptidase inhibitor, clade B (ovalbumin), member 13
  ENST ID: ENST00000415733
  CDS Start-End: 1-375
acaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtgagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaaggttaatcactgttctgaagatggtgtttgtaacaccagttatgcttcatacttctgaggtaggagtctggacatgactcagcaggcaagactcaactctggcagtggggttcagacatcagacaaattgaggactagctaaaacagggaagagttggaagcacctctccagaagacatgcccaccagtgtgccatatcagtttacccttgccatggctacacccagaagttatggatgaagctgctatggatgaagctggaggacattatgctaagtgaaaagtaatacacaaaaagaaaagtactgaatgatctcacttaaatgtgtaatataaaaaagtcaaatacatagagaaagagaataaaatggtaactatcagggattggggagatgcagggagagggagaaaaaatagagagatataggtcaaaggatccaaagttgaagatatgtaggatgaacgagtctagagctctaacgtacaagacaaggatgatggttaataataatgtattatatataagatttttgtgaaaatagtagatttaaggtgctcttgccacacatacaaaaaggataactatgtgagatgacggatatatgttaatttacttcactagagcaaccatttcactgtgtacatgtatatcaaaacatcaggttgtatatagagatataaaataaaaaagtaaaaaaaga

SEQ ID NO: 180531 - DNA, 2805 bp, Homo sapiens
  Payload ID: 15555
  Gene Symbol: SERPINB13
  Gene Name: serpin peptidase inhibitor, clade B (ovalbumin), member 13
  ENST ID: ENST00000438844
  CDS Start-End: 40-537
accgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgatgtggaaactgaggcacagagagtttaaataacttgcccaagattcctcagctgataagaggcaaactggatgctaacagaggcatctgaccccagagtctggactcttaaccatgaaccttaatttatccactgggataaataggcgatgggcaaaatgagaacctccccgtcgattctgccagcaaaccctttgtcagcaaggccctcagaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttca

SEQ ID NO: 180532 - DNA, 1913 bp, Homo sapiens
  Payload ID: 15556
  Gene Symbol: SERPINB2
  Gene Name: serpin peptidase inhibitor, clade B (ovalbumin), member 2
  Uniprot ID: P05120
  ENST ID: ENST00000299502
  CDS Start-End: 81-1328
gaactgtaacaactctcagaggagcattgcccgtcagacagcaactcagagaataaccagagaacaaccagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttccaaacaacaata

SEQ ID NO: 180533 - DNA, 717 bp, Homo sapiens
  Payload ID: 15556
  Gene Symbol: SERPINB2
  Gene Name: serpin peptidase inhibitor, clade B (ovalbumin), member 2
  ENST ID: ENST00000404622
  CDS Start-End: 377-717
gttgtgcccgctttcctactcagtgcaattgttccaggtttgcaggtcccaggttccaagactttgcggtcttcttttgttcacttggaaccgatatcttttggaggtgcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaat

SEQ ID NO: 180534 - DNA, 751 bp, Homo sapiens
  Payload ID: 15556
  Gene Symbol: SERPINB2
  Gene Name: serpin peptidase inhibitor, clade B (ovalbumin), member 2
  ENST ID: ENST00000443281
  CDS Start-End: 354-751
ttgcctgcagagcctgaggtcagggaaggtctcagatggttcataccttggtgtatacatgagtttcataggcctgggattaaggattatccctgcaatcttgcctggcattgactttctacctggtggggtggcagaagaagggggtcttctagtcctcccagtaatgaacaccccagtataggaagtcttttttagtaaggctgtggtatgtgtggtgcatatagggaaggggttctgggataggggctgggtgaaactccaaaccttcaaacaatgagtcaaagtcactttagaagcaggaaagcagaaagaagattgaccgtcttaccagatgcaacaagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaa

SEQ ID NO: 180535 - DNA, 2155 bp, Homo sapiens
  Payload ID: 15556
  Gene Symbol: SERPINB2
  Gene Name: serpin peptidase inhibitor, clade B (ovalbumin), member 2
  Uniprot ID: P05120
  ENST ID: ENST00000457692
  CDS Start-End: 334-1581
gtaacaactctcagaggagcattgcccgtcagacagcaactcagagaataaccagagaacaaccagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgtgcagaagaagctagaaaaaagattaattcctgggtcaagactcaaaccaaaggcaaaatcccaaacttgttacctgaaggttctgtagatggggataccaggatggtcctggtgaatgctgtctacttcaaaggaaagtggaaaactccatttgagaagaaactaaatgggctttatcctttccgtgtaaactcggctcagcgcacacctgtacagatgatgtacttgcgtgaaaagctaaacattggatacatagaagacctaaaggctcagattctagaactcccatatgctggagatgttagcatgttcttgttgcttccagatgaaattgccgatgtgtccactggcttggagctgctggaaagtgaaataacctatgacaaactcaacaagtggaccagcaaagacaaaatggctgaagatgaagttgaggtatacataccccagttcaaattagaagagcattatgaactcagatccattctgagaagcatgggcatggaggacgccttcaacaagggacgggccaatttctcagggatgtcggagaggaatgacctgtttctttctgaagtgttccaccaagccatggtggatgtgaatgaggagggcactgaagcagccgctggcacaggaggtgttatgacagggagaactggacatggaggcccacagtttgtggcagatcatccttttctttttcttattatgcataagataaccaactgcattttatttttcggcagattttcctcaccctaaaactaagcgtgctgcttctgcaaaagatttttgtagatgagctgtgtgcctcagaattgctatttcaaattgccaaaaatttagagatgttttctacatatttctgctcttctgaacaacttctgctacccactaaataaaaacacagaaataattagacaattgtctattataacatgacaaccctattaatcatttggtcttctaaaatgggatcatgcccatttagattttccttactatcagtttatttttataacattaacttttactttgttatttattattttatataatggtgagtttttaaattattgctcactgcctatttaatgtagctaataaagttatagaagcagatgatctgttaatttcctatctaataaatgcctttaattgttctcataatgaagaataagtaggtatccctccatgcccttctgtaataaatatctggaaaaaacattaaacaataggcaaatatatgttatgtgcatttctagaaatacataacacatatatatgtctgtatcttatattcaattgcaagtatataataaataaacctgcttcc

SEQ ID NO: 180536 - DNA, 762 bp, Homo sapiens
  Payload ID: 15556
  Gene Symbol: SERPINB2
  Gene Name: serpin peptidase inhibitor, clade B (ovalbumin), member 2
  ENST ID: ENST00000413956
  CDS Start-End: 280-762
gagaacaaccagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggatataatctataaaatagggagaatcacctctacctcatacagattctgcaaagattaaacgaggagaggagattgaaacaatggaggatctttgtgtggcaaacacactctttgccctcaatttattcaagcatctggcaaaagcaagccccacccagaacctcttcctctccccatggagcatctcgtccaccatggccatggtctacatgggctccaggggcagcaccgaagaccagatggccaaggtgcttcagtttaatgaagtgggagccaatgcagttacccccatgactccagagaactttaccagctgtgggttcatgcagcagatccagaagggtagttatcctgatgcgattttgcaggcacaagctgcagataaaatccattcatccttccgctctctcagctctgcaatcaatgcatccacagggaattatttactggaaagtgtcaataagctgtttggtgagaagtctgcgagcttccgggaagaatatattcgactctgtcagaaatattactcctcagaaccccaggcagtagacttcctagaatgt

SEQ ID NO: 180537 - DNA, 1777 bp, Homo sapiens
  Payload ID: 15557
  Gene Symbol: SERPINB3
  Gene Name: serpin peptidase inhibitor, clade B (ovalbumin), member 3
  Uniprot ID: P29508
  ENST ID: ENST00000283752
  CDS Start-End: 145-1317
aaatactaaccacagagggagaggcagcaagaggagaggcataaattcaggatctcacccttcattccacagacacacatagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatca

SEQ ID NO: 180538 - DNA, 1541 bp, Homo sapiens
  Payload ID: 15557
  Gene Symbol: SERPINB3
  Gene Name: serpin peptidase inhibitor, clade B (ovalbumin), member 3
  Uniprot ID: P29508
  ENST ID: ENST00000332821
  CDS Start-End: 66-1082
tagcctctctgcccacctctgcttcctctaggaacacaggagttccagatcacatcgagttcaccatgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagcttgaagagaaactcactgctgagaaattgatggaatggacaagtttgcagaatatgagagagacacgtgtcgatttacacttacctcggttcaaagtggaagagagctatgacctcaaggacacgttgagaaccatgggaatggtggatatcttcaatggggatgcagacctctcaggcatgaccgggagccgcggtctcgtgctatctggagtcctacacaaggcctttgtggaggttacagaggagggagcagaagctgcagctgccaccgctgtagtaggattcggatcatcacctacttcaactaatgaagagttccattgtaatcaccctttcctattcttcataaggcaaaataagaccaacagcatcctcttctatggcagattctcatccccgtagatgcaattagtctgtcactccatttggaaaatgttcacctgcagatgttctggtaaactgattgctggcaacaacagattctcttggctcatatttcttttctttctcatcttgatgatgatcgtcatcatcaagaatttaatgattaaaatagcatgcctttctctctttctcttaataagcccacatataaatgtactttttcttccagaaaaattctccttgaggaaaaatgtccaaaataagatgaatcacttaataccgtatcttctaaatttgaaatataattctgtttgtgacctgttttaaatgaaccaaaccaaatcatactttttctttgaatttagcaacctagaaacacacatttctttgaatttaggtgatacctaaatccttcttatgtttctaaattttgtgattctataaaacacatcatcaataaaatagtgacataaaatc

SEQ ID NO: 180539 - DNA, 1173 bp, Homo sapiens
  Payload ID: 15557
  Gene Symbol: SERPINB3
  Gene Name: serpin peptidase inhibitor, clade B (ovalbumin), member 3
  ENST ID: ENST00000356424
  CDS Start-End: 1-1173
atgaattcactcagtgaagccaacaccaagttcatgttcgacctgttccaacagttcagaaaatcaaaagagaacaacatcttctattcccctatcagcatcacatcagcattagggatggtcctcttaggagccaaagacaacactgcacaacagattaagaaggttcttcactttgatcaagtcacagagaacaccacaggaaaagctgcaacatatcatgttgataggtcaggaaatgttcatcaccagtttcaaaagcttctgactgaattcaacaaatccactgatgcatatgagctgaagatcgccaacaagctcttcggagaaaaaacgtatctatttttacaggaatatttagatgccatcaagaaattttaccagaccagtgtggaatctgttgattttgcaaatgctccagaagaaagtcgaaagaagattaactcctgggtggaaagtcaaacgaatgaaaaaattaaaaacctaattcctgaaggtaatattggcagcaataccacattggttcttgtgaacgcaatctatttcaaagggcagtgggagaagaaatttaataaagaagatactaaagaggaaaaattttggccaaacaagaatacatacaagtccatacagatgatgaggcaatacacatcttttcattttgcctcgctggaggatgtacaggccaaggtcctggaaataccatacaaaggcaaagatctaagcatgattgtgttgctgccaaatgaaatcgatggtctccagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatag

SEQ ID NO: 180540 - DNA, 1749 bp, Homo sapiens
  Payload ID: 15558
  Gene Symbol: SERPINB4
  Gene Name: serpin peptidase inhibitor, clade B (ovalbumin), member 4
  Uniprot ID: P48594
  ENST ID: ENST00000341074
  CDS Start-End: 117-1289
aagaggagaggcataaatttaggatctcacccttcattccacagacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccatagatgcaattagtctgtcactccatttagaaaatgttcacctagaggtgttctggtaaactgattgctggcaacaacagattctcttggctcatatttcttttctatctcatcttgatgatgatagtcatcatcaagaatttaatgattaaaatagcatgcctttctctctttctcttaataagcccacatataaatgtacttttccttccagaaaaatttcccttgaggaaaaatgtccaagataagatgaatcatttaataccgtgtcttctaaatttgaaatataattctgtttctgacctgttttaaatgaaccaaaccaaatcatactttctcttcaaatttagcaacctagaaacacacatttctttgaatttaggtgatacctaaatccttcttatgtttctaaattttgtgattctataaaacacatcatcaataaaataatgacataaaatca

SEQ ID NO: 180541 - DNA, 1116 bp, Homo sapiens
  Payload ID: 15558
  Gene Symbol: SERPINB4
  Gene Name: serpin peptidase inhibitor, clade B (ovalbumin), member 4
  ENST ID: ENST00000413673
  CDS Start-End: 1-1115
tcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgttgataggtcaggaaatgttcatcaccagtttcaaaagcttctgactgaattcaacaaatccactgatgcatatgagctgaagatcgccaacaagctcttcggagaaaagacgtatcaatttttacaggaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaaggatgtacaggccaaggtcctggaaataccatacaaaggcaaagatctaagcatgattgtgctgctgccaaatgaaatcgatggtctgcagaagcttgaagagaaactcactgctgagaaattgatggaatggacaagtttgcagaatatgagagagacatgtgtcgatttacacttacctcggttcaaaatggaagagagctatgacctcaaggacacgttgagaaccatgggaatggtgaatatcttcaatggggatgcagacctctcaggcatgacctggagccacggtctctcagtatctaaagtcctacacaaggcctttgtggaggtcactgaggagggagtggaagctgcagctgccaccgctgtagtagtagtcgaattatcatctccttcaactaatgaagagttctgttgtaatcaccctttcctattcttcataaggcaaaataagaccaacagcatcctcttctatggcagattctcatccccataga

SEQ ID NO: 180542 - DNA, 709 bp, Homo sapiens
  Payload ID: 15558
  Gene Symbol: SERPINB4
  Gene Name: serpin peptidase inhibitor, clade B (ovalbumin), member 4
  ENST ID: ENST00000436264
  CDS Start-End: 75-709
agacacacacagcctctctgcccacctctgcttcctctaggaacacaggagttccagatcacatcgagttcaccatgaattcactcagtgaagccaacaccaagttcatgttcgatctgttccaacagttcagaaaatcaaaagagaacaacatcttctattcccctatcagcatcacatcagcattagggatggtcctcttaggagccaaagacaacactgcacaacaaattagcaaggttcttcactttgatcaagtcacagagaacaccacagaaaaagctgcaacatatcatgaatatttagatgccatcaagaaattttaccagaccagtgtggaatctactgattttgcaaatgctccagaagaaagtcgaaagaagattaactcctgggtggaaagtcaaacgaatgaaaaaattaaaaacctatttcctgatgggactattggcaatgatacgacactggttcttgtgaacgcaatctatttcaaagggcagtgggagaataaatttaaaaaagaaaacactaaagaggaaaaattttggccaaacaagaatacatacaaatctgtacagatgatgaggcaatacaattcctttaattttgccttgctggaggatgtacaggccaaggtcctggaaataccatacaaaggcaaagatctaagcatgattgtgctgctgccaaatgaaatcgatggtctgca

SEQ ID NO: 180543 - DNA, 2783 bp, Homo sapiens
  Payload ID: 15559
  Gene Symbol: SERPINB5
  Gene Name: serpin peptidase inhibitor, clade B (ovalbumin), member 5
  Uniprot ID: P36952
  ENST ID: ENST00000382771
  CDS Start-End: 293-1420
gaacatgttggaggccttttggaagctgtgcagacaacagtaacttcagcctgaatcatttctttcaattgtggacaagctgccaagaggcttgagtaggagaggagtgccgccgaggcggggcggggcggggcgtggagctgggctggcagtgggcgtggcggtgctgcccaggtgagccaccgctgcttctgcccagacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaagacagacaccaaaccagtgcagatgatgaacatggaggccacgttctgtatgggaaacattgacagtatcaattgtaagatcatagagcttccttttcaaaataagcatctcagcatgttcatcctactacccaaggatgtggaggatgagtccacaggcttggagaagattgaaaaacaactcaactcagagtcactgtcacagtggactaatcccagcaccatggccaatgccaaggtcaaactctccattccaaaatttaaggtggaaaagatgattgatcccaaggcttgtctggaaaatctagggctgaaacatatcttcagtgaagacacatctgatttctctggaatgtcagagaccaagggagtggccctatcaaatgttatccacaaagtgtgcttagaaataactgaagatggtggggattccatagaggtgccaggagcacggatcctgcagcacaaggatgaattgaatgctgaccatccctttatttacatcatcaggcacaacaaaactcgaaacattattttctttggcaaattctgttctccttaagtggcatagcccatgttaagtcctccctgacttttctgtggatgccgatttctgtaaactctgcatccagagattcattttctagatacaataaattgctaatgttgctggatcaggaagccgccagtacttgtcatatgtagccttcacacagatagaccttttttttttttccaattctatcttttgtttccttttttcccataagacaatgacatacgcttttaatgaaaaggaatcacgttagaggaaaaatatttattcattatttgtcaaattgtccggggtagttggcagaaatacagtcttccacaaagaaaattcctataaggaagatttggaagctcttcttcccagcactatgctttccttctttgggatagagaatgttccagacattctcgcttccctgaaagactgaagaaagtgtagtgcatgggacccacgaaactgccctggctccagtgaaacttgggcacatgctcaggctactataggtccagaagtccttatgttaagccctggcaggcaggtgtttattaaaattctgaattttggggattttcaaaagataatattttacatacactgtatgttatagaacttcatggatcagatctggggcagcaccctataaatcaacaccttaatatgctgcaacaaaatgtagaatattcagacaaaatggatacataaagactaagtagcccataaggggtcaaaatttgctgccaaatgcgtatgccaccaacttacaaaaacacttcgttcgcagagcttttcagattgtggaatgttggataaggaattatagacctctagtagctgaaatgcaagaccccaagaggaagttcagatcttaatataaattcactttcatttttgatagctgtcccatctggtcatttggttggcactagactggtggcaggggcttctagctgacttgcacagggattctcacaatagccgatatcagaatttgtgttgaaggaacttgtctcttcatctaatatgatagcgggaaaaggagaggaaactactgcctttagaaaatataagtaaagtgattaaagtgctcacgttaccttgacacatagtttttcagtctatgggtttagttactttagatggcaagcatgtaacttatattaatagtaatttgtaaagttggttggataagctatccgtgttgcaggttcatggattacttctctataaaaaatatgtatttaccaaaaattttgtgacattccttctcccatctcttccttgacctgcattgtaaataggttcttcttgttctgagattcaatattgaatttttcctatgctattgacaataaaatattattgaactaca

SEQ ID NO: 180544 - DNA, 560 bp, Homo sapiens
  Payload ID: 15559
  Gene Symbol: SERPINB5
  Gene Name: serpin peptidase inhibitor, clade B (ovalbumin), member 5
  ENST ID: ENST00000424602
  CDS Start-End: 174-560
atggtgaacaaaatggacttaggtccattttggggctgttttcaaagacgggctgttgggttgagtactgtcgcctctcatcccccatgttggcagtatttccagctcccaaccctttgagcaccaggaacactgcagagggagtaaaatcacttaaccatacaaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaa

SEQ ID NO: 180545 - DNA, 1268 bp, Homo sapiens
  Payload ID: 15559
  Gene Symbol: SERPINB5
  Gene Name: serpin peptidase inhibitor, clade B (ovalbumin), member 5
  Uniprot ID: P36952
  ENST ID: ENST00000489441
  CDS Start-End: 96-791
agacacggtcgcctccacatccaggtctttgtgctcctcgcttgcctgttccttttccacgcattttccaggataactgtgactccaggcccgcaatggatgccctgcaactagcaaattcggcttttgccgttgatctgttcaaacaactatgtgaaaaggagccactgggcaatgtcctcttctctccaatctgtctctccacctctctgtcacttgctcaagtgggtgctaaaggtgacactgcaaatgaaattggacaggttcttcattttgaaaatgtcaaagatgtaccctttggatttcaaacagtaacatcggatgtaaacaaacttagttccttttactcactgaaactaatcaagcggctctacgtagacaaatctctgaatctttctacagagttcatcagctctacgaagagaccgtatgcaaaggaattggaaactgttgacttcaaagataaattggaagaaacgaaaggtcagatcaacaactcaattaaggatctcacagatggccactttgagaacattttagctgacaacagtgtgaacgaccagaccaaaatccttgtggttaatgctgcctactttgttggcaagtggatgaagaaattttctgaatcagaaacaaaagaatgtcctttcagagtcaacaaggtatgtggggcagcatgtagcagtaaaaggagcccaattatagatgtgaaaaatgatagggacagagtggggcataaatccattccaatgaggaacctgagggcacggccggcaaagtgcctttcctgagatgaacagctggaaggtaagtggtacaaaaagagccagaatccagaggccccccctcctcttttccataatgtcttcaaggatctgagctgagtgaaactttatagaatttgtaacccagcgaggaaagctaagtcaccagctgaaaaatagctacaaacatctgagaactttagcagaaaaggaaaagaccaaactctgttatcagaggactttggattatcatgaaaccttgacatctaggaatcttgttcctgattgattaacttctctaacatctcatttccttatcggttgatagcgaagtatattgttctgggattttaatttataatttataagatgctttgatggctgggcgtggtggctcatgcctgtaatcccatgactttgggaagccgaggagggcagatcacctgaggtcaggagttggagaccagcctggccaacatggtgaaaccctgtctctactaaaaa

SEQ ID NO: 180546 - DNA, 1604 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000335686
  CDS Start-End: 335-1465
gcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180547 - DNA, 3265 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000380520
  CDS Start-End: 1996-3126
tattagaaattagtaatcttaaaatatgtttggaaaggcttggcaagccaggagtgcccagtgccccaagtattctgtgtaatgaataaagaagagtttgaaaacaaaatatttaaacaagcacagcaaacaagctttatcaggtgtatgagttattgtcttggtttcccgtggctgctgtaacaaatgaccatggattcgtggctaaactgcacatgtttattttctcagagttctgaggttggaggttggaaatgggttccgcagggccaggctcctccagaggatcctccttgcctttccagctactgcagctgtggtccttgcgtttcttggcttgaggcccttcatcttcaaggccagtggagtggcattttgctttattctttgcattgctttttcccgtgagatctccccctccctccctcttagaaggatacctgtgattacatttagggtcaactggaacaatccaggataatctcccatctcaagagcctgaatctaatcgtgctgcacagtcccttttgccatgtaaggggcattcacaggtcccagggattatgacccaggtatctttggagcacttgctcagccaaccccagctccaaatgtaaaggcatgcacagtggagagccgcttaattcagcatctcctcacagggcctccagtaggcacctccttccctctcccatctgctccaggaaatgtctgctccagcttctccccttccttgttccgtgggttcccactcactgctcaagtgagtcactgggactgtcttagaatgctggcattctctgactgggacatattcatttggtaaacatctgagaactgtgtcagagcaggcaggccccgcatccctgcattcctgcatcccctccttcccagcctgactgcctgtggggcccttagctgccccttgtcctctcacctgattctgcagattcttcttcttgagcagcagctcagaaagcgcatccgccctgcgtttcaagcccagctacttcttagcttcacttccgtcaacttcaccttccctgtagtgcagtggggcattgatggtaggtctctctaagggcttggtggactttaacatgtgattctgtgattccgacttgcctgaagataccccagctcccccctcccgactatccagctgcattcctgctctggaccctgctggggctgccacacccactgcacggcagggctagagagatgtgcagcctgaccctacccctgagcctgtctgtgaaggtggagatgggcatgcacccacagcccatgaggcaaggtggtgtcctgagtgtgctgtgagttcaggcgcaggaaggcctggcttgttgcagcaggatgtccccaagcgtggtccaaaattggggctttgccacctgcagggatttcctagaaggagatccaagggtcaggaggcatttgaaaggctttcacgcatctttgtatgtggcttgattgatccttttttaaggctcttgctacccagaaatgggattctctctctcattataaaaacatttggccatcttttcttgtgtaactgtcagtgaatgtatcattttgaatatttttcaaattaaaacagtacatttaagcccgcaaaacacaccaaagaatacaaacatagaagcaaaagccagtgccccttctgtaattccaccccaaggaagagactccaggaaagggtgcctccttcccactttctccacgtgcgggcaggcgtgcagggaggagtcctcacaaaacagggcggcgtttcacatagaactctttcattttccacacttaacattagaaacacacaaaataatgtggagggtcctaaaaagaaacagccagagttctgtgtgtgtttctgcttgcccactgaaccacagcatcggcggtgactgtcggtaaggcgcgtgagatgcagtcgcgtggaagctgtgcttaagtgatactgattttaaatcttgttccaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180548 - DNA, 1495 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000380524
  CDS Start-End: 226-1356
gattctccgggatattaccggagacggagtgttttattattagcctttcttaggtggacatttccatttgaattaaaagtcctttaggctgggcgtggtgcatggctgtaatctcagcaccttgggaggctgaggcaggaagatcacttgaggccaggcgttggagagcagcctgggcaaggtggcaagaaccttgtctctacaaaaaaaaaagcgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180549 - DNA, 1370 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000380529
  CDS Start-End: 101-1231
gacccgaggaccccgggcgcccaggcccagcgcccacggaagaggcggccggcgcgggatgggggcggcgcagagcctcccgggccacaggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180550 - DNA, 1338 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000380539
  CDS Start-End: 69-1199
gtccggcttgggttcccttccggagcctcgcagcggcagagaacggcgacgcggccgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180551 - DNA, 1375 bp, Homo sapiens
  Payload ID: 15560
  Gene Symbol: SERPINB6
  Gene Name: serpin peptidase inhibitor, clade B (ovalbumin), member 6
  Uniprot ID: P35237
  ENST ID: ENST00000380546
  CDS Start-End: 106-1236
ggcggctccggcgcctctgcccgccgttctgctcgctcgctccccgctctggagtacgtgtctggcttgggagccgctcggacacgctggcttgggtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattca

SEQ ID NO: 180552 - DNA, 2047 bp, Homo sapiens
  Payload ID: 15560
  Gene Symbol: SERPINB6
  Gene Name: serpin peptidase inhibitor, clade B (ovalbumin), member 6
  ENST ID: ENST00000616722
  CDS Start-End: 767-1909
actgcagcctctgcctcccgggttcaagtgattctcctgcctcagcttccccagcaactgagattacaggcacgcgccattacactcggctaatttttgtatttttagtagagacggggttttgccatgttggccaggctggtctggaactcctgacctccagtgatccgcctgcctcggcctcccagtgttgggattactggcgtgagccccgcgcccgcccctggctggcttctttgccgcaagctgtttcatcagcaaagtctttgtgacctgtatctagtctgctcatttttaaatgcgtgttctgcactccccagtggatggccgtgtatcaggagccggcccttttctggaaacaggccagcattcagtctccacagaggcaccataaacacgctggtggggccctgtactgtggtcaaagtcaaggcctccgggcaggactcgcggcccctccggctggcgggtggggttgacccgcacgtcccgccccgcctctcccttcgcgctccggacgggcgacggtagctcgagacccgggactccgcccgcctccccgcgagtatttgaggtccggggcggctccggcgcctctgcccgccgttctgctcgctcgctccccgctctggaaacaccaccgatagccacaccgaagagttctcccatttgctggttcccggacaaaaaagctgctgatcccttgagcacactgcagtgaagctcccagctgacatgtcctgtccatgtaaacagaacttcctccatgtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattc

SEQ ID NO: 180553 - DNA, 1570 bp, Homo sapiens
  Payload ID: 15560
  Gene Symbol: SERPINB6
  Gene Name: serpin peptidase inhibitor, clade B (ovalbumin), member 6
  ENST ID: ENST00000612421
  CDS Start-End: 245-1432
agtcttggggcgccgggtgttaggagccgggcgggaggcggagagaggccgaggggttcggcgccaaacggtgccatccgggccccctgcgtgtgttcactggactggccgtgctgggcttggccaatccgcagcactttcaggtcgcccagacctgtggagacgatcgtgtggaccagcccggatctccttaccgctctgtgtttgaattaaactccctacaggcaaactattacaggctttgatgtcttcaaggcaaagaggaaactttaactacaaattggcatttaagtctgccatcatggatgttctcgcagaagcaaatggcacctttgccttaaaccttttgaaaacgctgggtaaagacaactcgaagaatgtgtttttctcacccatgagcatgtcctgtgccctggccatggtctacatgggggcaaagggaaacaccgctgcacagatggcccagatactttctttcaataaaagtggcggtggtggagacatccaccagggcttccagtctcttctcaccgaagtgaacaagactggcacgcagtacttgcttaggatggccaacaggctctttggggaaaagtcttgtgatttcctctcatcttttagagattcctgccaaaaattctaccaagcagagatggaggagcttgactttatcagcgccgtagagaagtccagaaaacacataaacacctgggtagctgaaaagacagaaggtaaaattgcggagttgctctctccgggctcagtggatccattgacaaggctggttctggtgaatgctgtctatttcagaggaaactgggatgaacagtttgacaaggagaacaccgaggagagactgtttaaagtcagcaagaatgaggagaaacctgtgcaaatgatgtttaagcaatctacttttaagaagacctatataggagaaatatttacccaaatcttggtgcttccatatgttggcaaggaactgaatatgatcatcatgcttccggacgagaccactgacttgagaacggtggagaaagaactcacttacgagaagttcgtagaatggacgaggctggacatgatggatgaagaggaggtggaagtgtccctcccgcggtttaaactagaggaaagctacgacatggagagtgtcctgcgcaacctgggcatgactgatgccttcgagctgggcaaggcagacttctctggaatgtcccagacagacctgtctctgtccaaggtcgtgcacaagtcttttgtggaggtcaatgaggaaggcacggaggctgcagccgccacagctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccatttgtgggatgccgcattc

SEQ ID NO: 180554 - DNA, 1976 bp, Homo sapiens
  Payload ID: 15561
  Gene Symbol: SERPINB7
  Gene Name: serpin peptidase inhibitor, clade B (ovalbumin), member 7
  Uniprot ID: O75635
  ENST ID: ENST00000336429
  CDS Start-End: 93-1235
gagaagtcttaggaggtaggaggcaggaggaactgaagcccagctgtgaaggccgcagactgcagtgagaggaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacatacctgta

SEQ ID NO: 180555 - DNA, 2203 bp, Homo sapiens
  Payload ID: 15561
  Gene Symbol: SERPINB7
  Gene Name: serpin peptidase inhibitor, clade B (ovalbumin), member 7
  Uniprot ID: O75635
  ENST ID: ENST00000398019
  CDS Start-End: 326-1468
gtctactcatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgggggaaaatacctagggctcaacagtcttgagaagtgtggaaacattttctttgtgagtgagaacagatcacctagagaaaggagaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacata

SEQ ID NO: 180556 - DNA, 560 bp, Homo sapiens
  Payload ID: 15561
  Gene Symbol: SERPINB7
  Gene Name: serpin peptidase inhibitor, clade B (ovalbumin), member 7
  ENST ID: ENST00000431370
  CDS Start-End: 177-560
attaaactcatcacacaacatccagatcggataatggtcctcttgtctgcttctccaccttacagcttgtctatgactgatttaagtggtgtcatgggagaatggcatgggaatcggatgccagctgaaaaatttgtgttccatctttgaagagataagctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcga

SEQ ID NO: 180557 - DNA, 587 bp, Homo sapiens
  Payload ID: 15561
  Gene Symbol: SERPINB7
  Gene Name: serpin peptidase inhibitor, clade B (ovalbumin), member 7
  ENST ID: ENST00000425392
  CDS Start-End: 205-587
tcagtgctgtcaccagtgctgctgctgtcatcaacctctcccttgggagttgagccaaagggaagtcttgggaattttccctgaaccttggtataggtgtgctgggaggagtgagaagtcttaggaggtaggaggcaggaggaactgaagcccagctgtgaaggccgcagactgcagtgagaggaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcg

SEQ ID NO: 180558 - DNA, 561 bp, Homo sapiens
  Payload ID: 15561
  Gene Symbol: SERPINB7
  Gene Name: serpin peptidase inhibitor, clade B (ovalbumin), member 7
  ENST ID: ENST00000447428
  CDS Start-End: 68-561
tttcagactcacccaaccagcggccaacttcctctatgaagacagtaaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctc

SEQ ID NO: 180559 - DNA, 2193 bp, Homo sapiens
  Payload ID: 15561
  Gene Symbol: SERPINB7
  Gene Name: serpin peptidase inhibitor, clade B (ovalbumin), member 7
  Uniprot ID: O75635
  ENST ID: ENST00000540675
  CDS Start-End: 361-1452
gctctgagtcatagggaagccatcccagaagccaggtctactcatcaataagcagctgcctgtgcagagtgcaggctgcacctttggacagcctttaaaactgaattctcagaattttagaacaaatttttgtctagaaatgctgactttggttcattaggtagtggtaaaacaggctcccttcgaagctctccttcatcaccttcctaagtgcatgggggaaaatacctagggctcaacagtcttgagaagtgtggaaacattttctttgtgagtgagaacagatcacctagagaaaggagaccagattcccatcactgcttctgggtatcagatgctagcgctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacatacctgta

SEQ ID NO: 180560 - DNA, 1951 bp, Homo sapiens
  Payload ID: 15561
  Gene Symbol: SERPINB7
  Gene Name: serpin peptidase inhibitor, clade B (ovalbumin), member 7
  Uniprot ID: O75635
  ENST ID: ENST00000546027
  CDS Start-End: 68-1210
tttcagactcacccaaccagcggccaacttcctctatgaagacagtaaggctgcactccattttgcaatggcctcccttgctgcagcaaatgcagagttttgcttcaacctgttcagagagatggatgacaatcaaggaaatggaaatgtgttcttttcctctctgagcctcttcgctgccctggccctggtccgcttgggcgctcaagatgactccctctctcagattgataagttgcttcatgttaacactgcctcaggatatggaaactcttctaatagtcagtcagggctccagtctcaactgaaaagagttttttctgatataaatgcatcccacaaggattatgatctcagcattgtgaatgggctttttgctgaaaaagtgtatggctttcataaggactacattgagtgtgccgaaaaattatacgatgccaaagtggagcgagttgactttacgaatcatttagaagacactagacgtaatattaataagtgggttgaaaatgaaacacatggcaaaatcaagaacgtgattggtgaaggtggcataagctcatctgctgtaatggtgctggtgaatgctgtgtacttcaaaggcaagtggcaatcagccttcaccaagagcgaaaccataaattgccatttcaaatctcccaagtgctctgggaaggcagtcgccatgatgcatcaggaacggaagttcaatttgtctgttattgaggacccatcaatgaagattcttgagctcagatacaatggtggcataaacatgtacgttctgctgcctgagaatgacctctctgaaattgaaaacaaactgacctttcagaatctaatggaatggaccaatccaaggcgaatgacctctaagtatgttgaggtattttttcctcagttcaagatagagaagaattatgaaatgaaacaatatttgagagccctagggctgaaagatatctttgatgaatccaaagcagatctctctgggattgcttcggggggtcgtctgtatatatcaaggatgatgcacaaatcttacatagaggtcactgaggagggcaccgaggctactgctgccacaggaagtaatattgtagaaaagcaactccctcagtccacgctgtttagagctgaccacccattcctatttgttatcaggaaggatgacatcatcttattcagtggcaaagtttcttgcccttgaaaatccaattggtttctgttatagcagtccccacaacatcaaagaaccaccacaagtcaatagatttgagtttaattggaaaaatgtggtgtttcctttgagtttatttcttcctaacattggtcagcagatgacactggtgacttgacccttcctagacacctggttgattgtcctgatccctgctcttagcattctaccaccatgtgtctcacccatttctaatttcattgtctttcttcccacgctcatttctatcattctcccccatgacccgtctggaaattatggagagtgctcaactggtaaggagaacgtagaagtagccctagggatcctttttgaaactctacagttatcgcagatattctagcttcattgtaagcaatctaggaaataagccctgctgctttctagaaataagtgtgaaggataaattttctttgttgacctatgaagattttagagtttaccttcatatgtttgattttaaatcagtgtataatctagatggtaaaaaatgtgaaattgggattagggaccaaccaaaatatttcattaatgctttcaattgacaaattttggtctttctttgataagacaatatgtacatagttttttcaaatattaaagatcttttaactgttggcagttgttatctacagaatcatatctcatatgctgtgtagtttataagttttttctctatttatcagaataaagaaatacaacatacctgta

SEQ ID NO: 180561 - DNA, 979 bp, Homo sapiens
  Payload ID: 15562
  Gene Symbol: SERPINB8
  Gene Name: serpin peptidase inhibitor, clade B (ovalbumin), member 8
  ENST ID: ENST00000295211
  CDS Start-End: 1-569
gtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtgattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactgga

SEQ ID NO: 180562 - DNA, 3387 bp, Homo sapiens
  Payload ID: 15562
  Gene Symbol: SERPINB8
  Gene Name: serpin peptidase inhibitor, clade B (ovalbumin), member 8
  Uniprot ID: P50452
  ENST ID: ENST00000353706
  CDS Start-End: 170-1294
caagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggaggtgggggcctctgccagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatat

SEQ ID NO: 180563 - DNA, 3477 bp, Homo sapiens
  Payload ID: 15562
  Gene Symbol: SERPINB8
  Gene Name: serpin peptidase inhibitor, clade B (ovalbumin), member 8
  Uniprot ID: P50452
  ENST ID: ENST00000397985
  CDS Start-End: 257-1381
caatgtgtacactttttataaaaaccaccctccaaggaccaggcactggccctctctccggtgcccacagacatccacacaggcccaaagaatcagggattgcacaagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatatata

SEQ ID NO: 180564 - DNA, 1178 bp, Homo sapiens
  Payload ID: 15562
  Gene Symbol: SERPINB8
  Gene Name: serpin peptidase inhibitor, clade B (ovalbumin), member 8
  Uniprot ID: P50452
  ENST ID: ENST00000397988
  CDS Start-End: 63-791
gtcaaagcagcagcggcggcggcggcggcggcagcagcagcagcagcaggagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtgaaagagtgatggatcttgaagaatttgaagctaactccaggacaggcagaggacaaacaaggatgctgatgaagtcttcttgcattccccatttctcgtctcatgctcccttctcatgcctcccttcatcttcagatgaaacacaattccctctcttttactctgagttgccctctgatttaaccctgaatagtcccctcattagactcagaagcagagttctgagccatgctctttgtcttttgtcaaacaatctctcccactcacagtagtatgtattgcatgaagattaatgtaatgaattggttagaattttctaaactgttaaaaaatgtttttaacatttgaaaggagttaggtacaaattgtttttattaaaaatttctgcctgtctca

SEQ ID NO: 180565 - DNA, 564 bp, Homo sapiens
  Payload ID: 15562
  Gene Symbol: SERPINB8
  Gene Name: serpin peptidase inhibitor, clade B (ovalbumin), member 8
  ENST ID: ENST00000441827
  CDS Start-End: 72-564
aggcttgcgatttgctgcgctgtgatttgctgccggatgggagcggggggtgacgcgagcaaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgcca

SEQ ID NO: 180566 - DNA, 580 bp, Homo sapiens
  Payload ID: 15562
  Gene Symbol: SERPINB8
  Gene Name: serpin peptidase inhibitor, clade B (ovalbumin), member 8
  ENST ID: ENST00000448851
  CDS Start-End: 209-580
gtgcgtgagagaggggaagggaggaaggccagagcaggaatcagagcgaggcaaaggcgggcaggaactaggagaatgacggcgggaggcggccgggaaagagagtcgcggggctgtgggggtcgccctggcaccagccggggtcccaagccccaccgcgagacccggcgaaggccgagggccgggtcccgagaacagaccttctctgatggatgacctctgtgaagcaaatggcacttttgccatcagcttatttaaaatattgggggaagaggacaactcaagaaacgtattcttctctcccatgagcatctcctctgccctggccatggtcttcatgggggcaaagggaagcactgcagcccagatgtcccaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagac

SEQ ID NO: 180567 - DNA, 3192 bp, Homo sapiens
  Payload ID: 15562
  Gene Symbol: SERPINB8
  Gene Name: serpin peptidase inhibitor, clade B (ovalbumin), member 8
  Uniprot ID: P50452
  ENST ID: ENST00000542677
  CDS Start-End: 521-1099
caagccagagcaatcgaacggttctgagtcatctgccggaagccttgccctcaatcaaggcggacgtgaagcatctacaaaggaggaatagtcaaagcagcagcggcggcggcggcggcggcagcagcagcagcagcaggaggcactttgtttatacaaagacggagatattcaccgaggtttccagtcacttctcagtgaagttaacagaactggcactcagtacttgcttagaactgccaacagactctttggagaaaagacgtgtgatttccttccagactttaaagaatactgtcagaagttctatcaggcagagctggaggagttgtcctttgctgaagacactgaagagtgcaggaagcatataaatgactgggtggcagagaagactgaaggtaagatttcagaggtactggatgctgggacagtcgatcccctgacaaagctggtccttgtgaatgccatttatttcaagggaaagtggaatgagcaatttgacagaaagtacacaaggggaatgctctttaaaaccaacgaggaaaaaaagacagtgcagatgatgtttaaggaagctaagtttaaaatggggtatgcggatgaggtacacacccaggtcctggagctgccctatgtggaagaggagctgagcatggtcattctgcttcccgatgacaacacggacctcgccgtggtggaaaaagcacttacatatgagaaattcaaagcctggacaaattcagaaaagttgacaaaaagtaaggttcaagttttccttcccagattaaagctggaggagagttatgacttggagcctttccttcgaagattaggaatgatcgatgcttttgacgaagccaaggcagacttttctggaatgtcaactgagaagaatgtgcctctgtccaaggttgcccacaagtgcttcgtggaggtcaatgaggaaggcacagaggctgccgcagccactgctgtggtcaggaattcccggtgcagcagaatggagccaagattctgtgcagaccacccttttcttttcttcatcaggcaccacaaaaccaactgcatcttgttctgtggcaggttctcttctccgtaaagaggagcaattgctgtacataccctcctttccttctacctatcttgccttaattaacattccctgtgacctagttggtgcagtggcttgaatgccaaaataaagcgtgtgcactggatagtgtgtgaaagtctttgctgaaagttccagagccattgagaataactgaggccgcagatgcatgaaatttgggcctgggaaggctatgctggttttggagtgtttggggtgcctgccattgcctctgccttcacctaagtctgtgcccattgtttcaggggatcttatggagcatctcagggcttcaggagccagccctcttccatccgcccggctctgcccaccaccactgccaggctgaacaggggactagtgcccaggtgacactgcacacaaagccaagggcaaaccctatagagtaaagctgcagccaccctgtgtctcatgtgcagctgaaatagtgatctgcttctgtcactgtcacatagacagccctgcatgccccctgtctcacacagtttgtaatgaagacagctccttctcatctttccataagcctgagatacaagttcagggactcagcaatgcactttaggactgagctaggaggcaaatatctgaagcttgctatgctgttctttccattccttttccctctgaaacacacaaaataccaaaggaacttacgcaacacaccactgagtcctctaactaatcatatgtgctcagacacagctcaagcacaccccttagttaagaaagaacctccatatacattaatttttttctgcctaaaaataaaattgcgttgtggcagcaatttggaaactacagcaaagtctccaaaaaaattgaagtcacccacaattccaacacacagcaatcactgctgttaatagtgatatacatccttccctattatgtgtatgcaaatagaaatttataagcattttactacaagttaatcatatccttcagtagcttatttcttcccttatgaaaaacctcccttaagatctttccaggtcatcaatttgatgtgcatagtattccactgtgtggctggatttctataattgaatctaattttagacagtttgagtaattaaaattatttctattaacaaataatagattgctaataatatatattatgctgttttggatatactaaatatttgctcacatccttaatatattttttaaaattcctaacaatagtactgttgagataaaagttgagcacattttgagacttcttccaaattggtccctagaaagttacactggtttgtactctcacttatgtcactgtttataccaccactgactgctgcctgctttattatttctttaatgagttggactgaacagtggttaatcctgactctgtttttgactgacagttaacagttacatgaaccattcatattacagctcttacttaaatttgaccaagccaggatatatctgttaggccacattcatttagggatcatgttttccaaagcaggtttgggcaaaattaatccacaggactgaaaggtatacatctgtgagttttgttctcacttccacctctaatttgaagaacactttaattgacacagaatacatttcacatatttaacctctacaataagttctgacacattttccatgaaacaaaccatcgctatattcaagataatgaacctatctatcatactcccaaattccttcttgcatctttgtaatttctcactcttccttctccctctccccgtcccatcccaaccactgatctgctcaggcaactaccaatcttctttctgtcactatagattaatttgcatttttaaagaaatttacatacatggaaccatacatcatctatgctttgtagtatgactcctgtcactcagtacaattattttgagattcatttatgttattgtatgtatcaatagttcatcccttttattggtaagtaacatttttttgtataggtataccatgatttgttgatgaacaaatttacctgttgatgaacatttacgttgttaccaagatttttgctattgaaaataaagtttttatgaatatttatatat

SEQ ID NO: 180568 - DNA, 919 bp, Homo sapiens
  Payload ID: 15562
  Gene Symbol: SERPINB8
  Gene Name: serpin peptidase inhibitor, clade B (ovalbumin), member 8
  ENST ID: ENST00000493661
  CDS Start-End: 1-130
gctgccctatgtggaagaggagctgagcatggtcattctgcttcccgatgacaacacggacctcgccgtggatacactgagaagcacaagcttcttctgtgacattcttgccaacattatcagcacctgagtgtaagtacagaaacatcagacggcattgaattgagggatattctaccaaataattggctgaaactctctaaaagaggcaatgtcataaaagacaagcactgtggaagtgccacaggaggatgtgtgataactaattgcaacctgcgagcttctttgggtcccacaaaacacctgaataaatacaaaagaagacattcaaatgtccaagaaggaaatataaaaggatttggttatggtagttatcaagacattcatatgaaatgcacagtgaaataccaccacaactctaccaaagtaggtaaaattaaaaccactgacaacatcaagagtgggcaacgatgtagaacaactggaattctcctacatttttcttgggaataaattagtaaagacactcaaaaaattggccatatctacaaaagcctaatagtgttgaagcaaacgttgcactaagcaaagttaagcatgtcctataacctgaatgccgtcttccaccaaaatttatatgttgaaacccaacatccaatgtatcagtattaagaggtgggacctttgggaggtgattaggtcctgaggaaaaagccctcataaatgggattgatgtcctcataaaaggggccccagagaactaccttgcccctctgccatgtgagtacacagtgagaaggtgccatctataaagcagagaataagcccttaccagacatcaaatataatggtactttgattttggacttcccagcctctaaaattgtacgaaataaatttatgttgtttataagccacc

SEQ ID NO: 180569 - DNA, 4118 bp, Homo sapiens
  Payload ID: 15563
  Gene Symbol: SERPINB9
  Gene Name: serpin peptidase inhibitor, clade B (ovalbumin), member 9
  Uniprot ID: P50453
  ENST ID: ENST00000380698
  CDS Start-End: 91-1221
ccgggtcctgcgcctcgggggtcggcgtccaggctcggagcgcggcacggagacggcggcagcgctggactaggtggcaggccctgcatcatggaaactctttctaatgcaagtggtacttttgccatacgccttttaaagatactgtgtcaagataacccttcgcacaacgtgttctgttctcctgtgagcatctcctctgccctggccatggttctcctaggggcaaagggaaacaccgcaacccagatggcccaggcactgtctttaaacacagaggaagacattcatcgggctttccagtcgcttctcactgaagtgaacaaggctggcacacagtacctgctgagaacggccaacaggctctttggagagaaaacttgtcagttcctctcaacgtttaaggaatcctgtcttcaattctaccatgctgagctgaaggagctttcctttatcagagctgcagaagagtccaggaaacacatcaacacctgggtctcaaaaaagaccgaaggtaaaattgaagagttgttgccgggtagctcaattgatgcagaaaccaggctggttcttgtcaatgccatctacttcaaaggaaagtggaatgaaccgtttgacgaaacatacacaagggaaatgccctttaaaataaaccaggaggagcaaaggccagtgcagatgatgtatcaggaggccacgtttaagctcgcccacgtgggcgaggtgcgcgcgcagctgctggagctgccctacgccaggaaggagctgagcctgctggtgctgctgcctgacgacggcgtggagctcagcacggtggaaaaaagtctcacttttgagaaactcacagcctggaccaagccagactgtatgaagagtactgaggttgaagttctccttccaaaatttaaactacaagaggattatgacatggaatctgtgcttcggcatttgggaattgttgatgccttccaacagggcaaggctgacttgtcggcaatgtcagcggagagagacctgtgtctgtccaagttcgtgcacaagagttttgtggaggtgaatgaagaaggcaccgaggcagcggcagcgtcgagctgctttgtagttgcagagtgctgcatggaatctggccccaggttctgtgctgaccaccctttccttttcttcatcaggcacaacagagccaacagcattctgttctgtggcaggttctcatcgccataaagggtgcacttaccgtgcactcggccatttccctcttcctgtgtccccagatccccactacagctccaagaggatgggcctagaaagccaagtgcaaagatgagggcagattctttacctgtctgccctcatgatttgccagcatgaattcatgatgctccacactcgcttatgctacttaatcagaatcttgagaaaatagaccataatgattccctgttgtattaaaattgcagtccaaatcccataggatggcaagcaaagttcttctagaattccacatgcaattcactctggcgaccctgtgctttcctgacactgcgaatacattccttaacccgctgcctcagtggtaataaatggtgctagatattgctactattttatagatttcctggtgcttagccttataaaaaaggttgtaaaatgtacatttatattttatcttttttttttttttttttctgagacgcagtctggctctctgtcgcccaggctggagtgcagtggctcgatctcggctcactgcaagctccgcctcccgggttcacgccattctcctgcctcagcctcccgagtagctgggactacaggcgcccgccaccacgcccggctaattttttgtatttttagtagagacggggtttcaccgtgttagccaggatggtgtcgatctcctgacctcgtgatccacccgcctcggcctcccaaagtgctgggattacaggcttgagccaccgcgcccggctatattttatcttttatctttttctttgacatttaccaatcaccaagcatgcaccaaacactgctttaggcactggggacacaaaggggacagagccatcctcctttgacacctggtcttcagttctgtgcccaacgtatatagttttgacaatgaccaggttggactgtttaatgtctttcaacttaccacgtaatcctcttgtagggatcacatctttctttatgatattgtatttctctacctctaacagtaaaaattccattcaacccttaaagctcacttcaaattcttctttgagaagtttttcctttctccgcaaccagatgtacatatttgaactctctttgtacttggagggcacttctttcgtggtagttcttttatttttattaatctctgtatccttagatagtcctccaacaaccaaaggttgggactctgtcttacatatctgggtgcccctcatagtgcagtaataagtaagttgattatatacgagctatgtaacttatattttttaatggttggatatcactgagtttttttttttaagaatttttttattgaggtaaacttcacataacataaaattaactattttaaagtgagaagttcagtgccacttagtattgttaacaatgttgcataaccaccacctttatttaaagttccaaaaaaaatgttctcctctaaaaggaaaccccatcccattaagcagatactctccattccttccttcctccagcccccagcaaccaccaatctgctttctgtctctatggatttatctattcttgctattttatataaattgaattgtatgagaccttttgtgtctggcttctttcacttagtacaagtttttgagatttatttacatagtagcatgtatcaacacttcatttttatggccaaataaaattgtattatgtgtttatagcacaatttatttatccactcattcattgatggactttgggttgtttctgacttttggctattgggaatagtgctgctatgaatgtttgtgtacctgtatttgtttgaatgcctattttgcattctcttgggtatatatctaggagtggaactgctgggtcatatgttaattctatgtttagctttttgaggaacagacaaactgttttccacagcagttgaaccattccacattcccaccagcaatgtatgagaattccaatttctgtccacttcctcaccaacacttattattttccttttcctttttttaaaaaaaataagttatggccatcttagtgggtgtgaagtggtatctcattgtgttttttatttgcatttcctatgtaatgagctagaaactaaagtacaaactagatgggacatccagtccctttgatagataatgctgagtaaaaaatgagatgaaagacatttgtttgtttttagaacacgagtgacagtttgttaaaaagctttagaggaggaatgaaaacaaagtgaagtacacttagaaaagggccaagtggacatcttggatgtcaagtgcctagttcagtatcttttttttttttttttttttttttgagacagtgcctcactctgtcacccaggctggagtgtagtggcatgatctgggctcactgcaacctcctcctcctggattcaagcaattctcttgcttcagcctcccaagtagctgagactacaagcacccaccatcacacccagctaattttgtatttttcagtagagacggggtttcgccacattggccgtgttggtcttgaactcctggcctcaagcgatccgcctacctcagcctcccaaagtgctaggattacaggcataagccactgagcccagccctagttcagtatcttttatgtaaattacaaacatctgcaacattatgtatcatatgcagatacttattgcatttcttttattagtggtgaaagtgttctatgcatttattggctcttgaatttcctcatctatgaattgtcattcatacacctacttttctgcttcgtttttacatatgtctttgcctattaaagatattatccctctgttttatattttctctcattcttgtattgccttttaaattttgttatgatgtttcattaataaacagtgttttgttttcctctataatcaa

SEQ ID NO: 180570 - DNA, 1594 bp, Homo sapiens
  Payload ID: 15564
  Gene Symbol: SERPINC1
  Gene Name: serpin peptidase inhibitor, clade C (antithrombin), member 1
  Uniprot ID: P01008
  ENST ID: ENST00000367698
  CDS Start-End: 120-1514
tctgccccaccctgtcctctggaacctctgcgagatttagaggaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgagacctaccaggacatcagtgagttggtatatggagccaagctccagcccctggacttcaaggaaaatgcagagcaatccagagcggccatcaacaaatgggtgtccaataagaccgaaggccgaatcaccgatgtcattccctcggaagccatcaatgagctcactgttctggtgctggttaacaccatttacttcaagggcctgtggaagtcaaagttcagccctgagaacacaaggaaggaactgttctacaaggctgatggagagtcgtgttcagcatctatgatgtaccaggaaggcaagttccgttatcggcgcgtggctgaaggcacccaggtgcttgagttgcccttcaaaggtgatgacatcaccatggtcctcatcttgcccaagcctgagaagagcctggccaaggtagagaaggaactcaccccagaggtgctgcaagagtggctggatgaattggaggagatgatgctggtggtccacatgccccgcttccgcattgaggacggcttcagtttgaaggagcagctgcaagacatgggccttgtcgatctgttcagccctgaaaagtccaaactcccaggtattgttgcagaaggccgagatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctca

SEQ ID NO: 180571 - DNA, 984 bp, Homo sapiens
  Payload ID: 15564
  Gene Symbol: SERPINC1
  Gene Name: serpin peptidase inhibitor, clade C (antithrombin), member 1
  ENST ID: ENST00000617423
  CDS Start-End: 120-899
tctgccccaccctgtcctctggaacctctgcgagatttagaggaaagaaccagttttcaggcggattgcctcagatcacactatctccacttgcccagccctgtggaagattagcggccatgtattccaatgtgataggaactgtaacctctggaaaaaggaaggtttatcttttgtccttgctgctcattggcttctgggactgcgtgacctgtcacgggagccctgtggacatctgcacagccaagccgcgggacattcccatgaatcccatgtgcatttaccgctccccggagaagaaggcaactgaggatgagggctcagaacagaagatcccggaggccaccaaccggcgtgtctgggaactgtccaaggccaattcccgctttgctaccactttctatcagcacctggcagattccaagaatgacaatgataacattttcctgtcacccctgagtatctccacggcttttgctatgaccaagctgggtgcctgtaatgacaccctccagcaactgatggaggtatttaagtttgacaccatatctgagaaaacatctgatcagatccacttcttctttgccaaactgaactgccgactctatcgaaaagccaacaaatcctccaagttagtatcagccaatcgcctttttggagacaaatcccttaccttcaatgacctctatgtctcagatgcattccataaggcatttcttgaggtaaatgaagaaggcagtgaagcagctgcaagtaccgctgttgtgattgctggccgttcgctaaaccccaacagggtgactttcaaggccaacaggcctttcctggtttttataagagaagttcctctgaacactattatcttcatgggcagagtagccaacccttgtgttaagtaaaatgttcttattctttgcacctcttcctatttttggtttgtgaacagaagtaaaaataaatacaaactacttccatctcacatta

SEQ ID NO: 180572 - DNA, 2437 bp, Homo sapiens
  Payload ID: 15565
  Gene Symbol: SERPIND1
  Gene Name: serpin peptidase inhibitor, clade D (heparin cofactor), member 1
  Uniprot ID: P05546
  ENST ID: ENST00000215727
  CDS Start-End: 284-1783
atgtgtgcatgctaacacagtaaccgtcatatactcaaagtgtcagctctaagaactggagatgaggagctgcaagccactctacagttatcaaaggcacagctgagggggtttgtgctgaccaagctggttgcctggtgtttggattgggacttatttactttggaaaatatgcagcaacagcccagcaccaaagttcacatcaaaatcccactgatgaccttggctgctttcatctctgaagcgccacttctcagaaacacagagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttgttggaatcaattctgcacaatagcccatgctgtaagctcatagaagtcactgtaactgtagtgtgtctgctgttacctagagggtctcacctccccactcttcacagcaaacctgagcagcgcgtcctaagcacctcccgctccggtgaccccatccttgcacacctgactctgtcactcaagcctttctccaccaggcccctcatctgaataccaagcacagaaatgagtggtgtgactaattccttacctctcccaaggagggtacacaactagcaccattcttgatgtccagggaagaagccacctcaagacatatgaggggtgccctgggctaatgttagggcttaattttctcaaagcctgacctttcaaatccatgatgaatgccatcagtccctcctgctgttgcctccctgtgacctggaggacagtgtgtgccatgtctcccatactagagataaataaatgtagccacatttactgtg

SEQ ID NO: 180573 - DNA, 1798 bp, Homo sapiens
  Payload ID: 15565
  Gene Symbol: SERPIND1
  Gene Name: serpin peptidase inhibitor, clade D (heparin cofactor), member 1
  Uniprot ID: P05546
  ENST ID: ENST00000406799
  CDS Start-End: 133-1632
taatgctgtgagggcctcttcctgggtcaaagccacagggaacctgccatgtggatgctgcagcggggtgtggatcagccaggccgcctttcactgtgttctgttttccctcccagctttagctccgccaaaatgaaacactcattaaacgcacttctcattttcctcatcataacatctgcgtggggtgggagcaaaggcccgctggatcagctagagaaaggaggggaaactgctcagtctgcagatccccagtgggagcagttaaataacaaaaacctgagcatgcctcttctccctgccgacttccacaaggaaaacaccgtcaccaacgactggattccagagggggaggaggacgacgactatctggacctggagaagatattcagtgaagacgacgactacatcgacatcgtcgacagtctgtcagtttccccgacagactctgatgtgagtgctgggaacatcctccagctttttcatggcaagagccggatccagcgtcttaacatcctcaacgccaagttcgctttcaacctctaccgagtgctgaaagaccaggtcaacactttcgataacatcttcatagcacccgttggcatttctactgcgatgggtatgatttccttaggtctgaagggagagacccatgaacaagtgcactcgattttgcattttaaagactttgttaatgccagcagcaagtatgaaatcacgaccattcataatctcttccgtaagctgactcatcgcctcttcaggaggaattttgggtacacactgcggtcagtcaatgacctttatatccagaagcagtttccaatcctgcttgacttcaaaactaaagtaagagagtattactttgctgaggcccagatagctgacttctcagaccctgccttcatatcaaaaaccaacaaccacatcatgaagctcaccaagggcctcataaaagatgctctggagaatatagaccctgctacccagatgatgattctcaactgcatctacttcaaaggatcctgggtgaataaattcccagtggaaatgacacacaaccacaacttccggctgaatgagagagaggtagttaaggtttccatgatgcagaccaaggggaacttcctcgcagcaaatgaccaggagctggactgcgacatcctccagctggaatacgtggggggcatcagcatgctaattgtggtcccacacaagatgtctgggatgaagaccctcgaagcgcaactgacaccccgggtggtggagagatggcaaaaaagcatgacaaacagaactcgagaagtgcttctgccgaaattcaagctggagaagaactacaatctagtggagtccctgaagttgatggggatcaggatgctgtttgacaaaaatggcaacatggcaggcatctcagaccaaaggatcgccatcgacctgttcaagcaccaaggcacgatcacagtgaacgaggaaggcacccaagccaccactgtgaccacggtggggttcatgccgctgtccacccaagtccgcttcactgtcgaccgcccctttcttttcctcatctacgagcatcgcaccagctgcctgctcttcatgggaagagtggccaaccccagcaggtcctagaggtggaggtctaggtgtctgaagtgccttgggggcaccctcattttgtttccattccaacaacgagaacagagatgttctggcatcatttacgtagtttacgctaccaatctgaattcgaggcccatatgagaggagcttagaaacgaccaagaagagaggcttg

SEQ ID NO: 180574 - DNA, 3190 bp, Homo sapiens
  Payload ID: 15566
  Gene Symbol: SERPINE1
  Gene Name: serpin peptidase inhibitor, clade E (nexin, plasminogen activator inhibitor type 1), member 1
  Uniprot ID: P05121
  ENST ID: ENST00000223095
  CDS Start-End: 158-1366
ggcccacagaggagcacagctgtgtttggctgcagggccaagagcgctgtcaagaagacccacacgcccccctccagcagctgaattcctgcagctcagcagccgccgccagagcaggacgaaccgccaatcgcaaggcacctctgagaacttcaggatgcagatgtctccagccctcacctgcctagtcctgggcctggcccttgtctttggtgaagggtctgctgtgcaccatcccccatcctacgtggcccacctggcctcagacttcggggtgagggtgtttcagcaggtggcgcaggcctccaaggaccgcaacgtggttttctcaccctatggggtggcctcggtgttggccatgctccagctgacaacaggaggagaaacccagcagcagattcaagcagctatgggattcaagattgatgacaagggcatggcccccgccctccggcatctgtacaaggagctcatggggccatggaacaaggatgagatcagcaccacagacgcgatcttcgtccagcgggatctgaagctggtccagggcttcatgccccacttcttcaggctgttccggagcacggtcaagcaagtggacttttcagaggtggagagagccagattcatcatcaatgactgggtgaagacacacacaaaaggtatgatcagcaacttgcttgggaaaggagccgtggaccagctgacacggctggtgctggtgaatgccctctacttcaacggccagtggaagactcccttccccgactccagcacccaccgccgcctcttccacaaatcagacggcagcactgtctctgtgcccatgatggctcagaccaacaagttcaactatactgagttcaccacgcccgatggccattactacgacatcctggaactgccctaccacggggacaccctcagcatgttcattgctgccccttatgaaaaagaggtgcctctctctgccctcaccaacattctgagtgcccagctcatcagccactggaaaggcaacatgaccaggctgccccgcctcctggttctgcccaagttctccctggagactgaagtcgacctcaggaagcccctagagaacctgggaatgaccgacatgttcagacagtttcaggctgacttcacgagtctttcagaccaagagcctctccacgtcgcgcaggcgctgcagaaagtgaagatcgaggtgaacgagagtggcacggtggcctcctcatccacagctgtcatagtctcagcccgcatggcccccgaggagatcatcatggacagacccttcctctttgtggtccggcacaaccccacaggaacagtccttttcatgggccaagtgatggaaccctgaccctggggaaagacgccttcatctgggacaaaactggagatgcatcgggaaagaagaaactccgaagaaaagaattttagtgttaatgactctttctgaaggaagagaagacatttgccttttgttaaaagatggtaaaccagatctgtctccaagaccttggcctctccttggaggacctttaggtcaaactccctagtctccacctgagaccctgggagagaagtttgaagcacaactcccttaaggtctccaaaccagacggtgacgcctgcgggaccatctggggcacctgcttccacccgtctctctgcccactcgggtctgcagacctggttcccactgaggccctttgcaggatggaactacggggcttacaggagcttttgtgtgcctggtagaaactatttctgttccagtcacattgccatcactcttgtactgcctgccaccgcggaggaggctggtgacaggccaaaggccagtggaagaaacaccctttcatctcagagtccactgtggcactggccacccctccccagtacaggggtgctgcaggtggcagagtgaatgtcccccatcatgtggcccaactctcctggcctggccatctccctccccagaaacagtgtgcatgggttattttggagtgtaggtgacttgtttactcattgaagcagatttctgcttccttttatttttataggaatagaggaagaaatgtcagatgcgtgcccagctcttcaccccccaatctcttggtggggaggggtgtacctaaatatttatcatatccttgcccttgagtgcttgttagagagaaagagaactactaaggaaaataatattatttaaactcgctcctagtgtttctttgtggtctgtgtcaccgtatctcaggaagtccagccacttgactggcacacacccctccggacatccagcgtgacggagcccacactgccaccttgtggccgcctgagaccctcgcgccccccgcgcccctctttttccccttgatggaaattgaccatacaatttcatcctccttcaggggatcaaaaggacggagtggggggacagagactcagatgaggacagagtggtttccaatgtgttcaatagatttaggagcagaaatgcaaggggctgcatgacctaccaggacagaactttccccaattacagggtgactcacagccgcattggtgactcacttcaatgtgtcatttccggctgctgtgtgtgagcagtggacacgtgaggggggggtgggtgagagagacaggcagctcggattcaactaccttagataatatttctgaaaacctaccagccagagggtagggcacaaagatggatgtaatgcactttgggaggccaaggcgggaggattgcttgagcccaggagttcaagaccagcctgggcaacataccaagacccccgtctctttaaaaatatatatattttaaatatacttaaatatatatttctaatatctttaaatatatatatatattttaaagaccaatttatgggagaattgcacacagatgtgaaatgaatgtaatctaatagaagcctaatcagcccaccatgttctccactgaaaaatcctctttctttggggtttttctttctttcttttttgattttgcactggacggtgacgtcagccatgtacaggatccacaggggtggtgtcaaatgctattgaaattgtgttgaattgtatgctttttcacttttgataaataaacatgtaaaaatgtttcaaaaaaataataaaataaataaatacgaagaatatgtcaggacagtca

SEQ ID NO: 180575 - DNA, 2195 bp, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENST ID: ENST00000258405
  CDS Start-End: 244-1440
cgataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaacagggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 180576 - DNA, 2161 bp, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENST ID: ENST00000409304
  CDS Start-End: 213-1406
ttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaagctatttctctgctatttgaaaatacaatagaagaaactga

SEQ ID NO: 180577 - DNA, 2569 bp, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENST ID: ENST00000409840
  CDS Start-End: 662-1855
aatccttggttaggaggaaagggagtggagaggaccgtgctgcctggcgttccccagctgcctttctttctgttttccccccaacggaatctctatgtggtctcctagagcctcgtgcctgcctctcagctagatgctgatatcattcccactcatgtagttgggaaggaagggtgtggcagagataaagggtccacggtcacgcagtatgtggggggtcacacagcctgtatgccaaagtggcacaccctgtgaatatgtagggtcgcacagcctttatgtgtcagtgccagagcctggacccgggtctgtagatgtgtgaaccgtgagctgataccatggatattcaaagatttacatcccatcaatgtttataccttcttgagaagaaatttgtgtcaaagcacactcctcctttcaagactacctcctcgccgtgctgcgtgatagccctagtatcacaaccaaaacacatgatacagaaagaggccagtatctgtgtggcttcaggctcttgtgcgttggccatgaagcaaaggaaggctgttgcatgaaataacctccttctgactccacccttgcatttgtgagatgtaaacagcagtgttaccaagaggtcttccagggaacacgttgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagcaggatggctggaacactgtactgaggaatgaatagaaaggcttccagatgtctaaaagattctttaaactactgaactgttacctaggttaacaaccctgttgagtatttgctgtttgtccagttcaggaatttttgttttgttttgtctatatgtgcggcttttcagaagaaatttaatcagtgtgacagaaaaaaaaatgttttatggtagcttttactttttatgaaaaaaaaattatttgccttttaaattcttttcccccatccccctccaaagtcttgatagcaagcgttattttggtggtagaaacggtgaaatctctagcctctttgtgtttttgttgttgttgttgttgttgttttatataatgcatgtattcactaaaataaaatttaaaaaactcctgtcttgctagacaaggttgctgttgtgcagtgtgcctgtcactactggtctgtactccttggatttgcatttttgtattttgtacaaagtaaaaataaactgttatgagtagtaaaaataaa

SEQ ID NO: 180578 - DNA, 581 bp, Homo sapiens
  Payload ID: 15567
  Gene Symbol: SERPINE2
  Gene Name: serpin peptidase inhibitor, clade E (nexin, plasminogen activator inhibitor type 1), member 2
  ENST ID: ENST00000423446
  CDS Start-End: 455-581
atcacagaacaagtgtgccatgacttttcaaacatgcctaattgaactctgtttgcgatttaacttctttttcaaaggtttatagttacctttatttcaaaatttgtcattttaaaatatgtgtttcctccttttcctccactgtatagtaattaagagtgtggaggatttggaggccagcgggctttggtttgaatctagaggctacatattggagggtatgagccaaagccaaatttctaaacatctccaagcccatccgtgagttgggcctaaaggtgtttaggcttaagggccacccctgaagtgttgtgaggatgaagcgaagagtatatcttaggcgctaagcacagtggcaggaatggagctgactttcgggacacgaggtggctgtggttgtggcattgggtaatatttgtcacagaagtacaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattg

SEQ ID NO: 180579 - DNA, 546 bp, Homo sapiens
  Payload ID: 15567
  Gene Symbol: SERPINE2
  Gene Name: serpin peptidase inhibitor, clade E (nexin, plasminogen activator inhibitor type 1), member 2
  ENST ID: ENST00000454956
  CDS Start-End: 287-546
gataaagcccccgccgccgcggcagccagcttgcgctgtggggctgcccgggctgcgcggcgtctgcaggcgccaccgctgcctctttccggctgtgaccctcctcgccgccgccgcttggctgcgtcctccgactccccgcgccgccgagaccaggctcccgctccggttgcggccgcaccgccctccgcggccgccccctggggatccagcgagcgcgggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatgg

SEQ ID NO: 180580 - DNA, 988 bp, Homo sapiens
  Payload ID: 15567
  Gene Symbol: SERPINE2
  Gene Name: serpin peptidase inhibitor, clade E (nexin, plasminogen activator inhibitor type 1), member 2
  ENST ID: ENST00000432738
  CDS Start-End: 162-988
agcccaggttcatctacatcctgttgagaagtttggcagctggaggtggacatgcacacactacactgaacctcctgcaacaagcactgcggaagggaccatttggatgttgctgccatacttttcagcggctgaaaaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagac

SEQ ID NO: 180581 - DNA, 1716 bp, Homo sapiens
  Payload ID: 15567
  Gene Symbol: SERPINE2
  Gene Name: serpin peptidase inhibitor, clade E (nexin, plasminogen activator inhibitor type 1), member 2
  Uniprot ID: P07093
  ENST ID: ENST00000447280
  CDS Start-End: 302-1531
agtgatacccgcagctgggagcaccggggccggcgtggctcctgcccggccatccgagccggccctgaccctgaacctgaggtttccagctgctcgccggcaacccctaccccggacttaggctgcgcgccgccggatggggagagactggcgcactcttacttgttacctctgcctgggcagagggaggtgacgcgcggtgtggggaaagcctttaacttggcctctggcagccgatttaacccgagcgagcaggtctttgctattttcatcatctgtagaaacgggagttgcgaggcggatgagtgactgcaggtcgtccttggtggaaggaaccatgaactggcatctccccctcttcctcttggcctctgtgacgctgccttccatctgctcccacttcaatcctctgtctctcgaggaactaggctccaacacggggatccaggttttcaatcagattgtgaagtcgaggcctcatgacaacatcgtgatctctccccatgggattgcgtcggtcctggggatgcttcagctgggggcggacggcaggaccaagaagcagctcgccatggtgatgagatacggcgtaaatggagttggtaaaatattaaagaagatcaacaaggccatcgtctccaagaagaataaagacattgtgacagtggctaacgccgtgtttgttaagaatgcctctgaaattgaagtgccttttgttacaaggaacaaagatgtgttccagtgtgaggtccggaatgtgaactttgaggatccagcctctgcctgtgattccatcaatgcatgggttaaaaatgaaaccagggatatgattgacaatctgctgtccccagatcttattgatggtgtgctcaccagactggtcctcgtcaacgcagtgtatttcaagggtctgtggaaatcacggttccaacccgagaacacaaagaaacgcactttcgtggcagccgacgggaaatcctatcaagtgccaatgctggcccagctctccgtgttccggtgtgggtcgacaagtgcccccaatgatttatggtacaacttcattgaactgccctaccacggggaaagcatcagcatgctgattgcactgccgactgagagctccactccgctgtctgccatcatcccacacatcagcaccaagaccatagacagctggatgagcatcatggtgcccaagagggtgcaggtgatcctgcccaagttcacagctgtagcacaaacagatttgaaggagccgctgaaagttcttggcattactgacatgtttgattcatcaaaggcaaattttgcaaaaataacaaggtcagaaaacctccatgtttctcatatcttgcaaaaagcaaaaattgaagtcagtgaagatggaaccaaagcttcagcagcaacaactgcaattctcattgcaagatcatcgcctccctggtttatagtagacagaccttttctgtttttcatccgacataatcctacaggtgctgtgttattcatggggcagataaacaaaccctgaagagtatacaaaagaaaccatgcaaagcaacgactactttgctacgaagaaagactcctttcctgcatctttcatagttctgttaaatatttttgtacatcgcttctttttcaaaactagttcttaggaacagactcgatgcaagtgtttctgttctgggaggtattggagggaaaaaacaagca

SEQ ID NO: 180582 - DNA, 356 bp, Homo sapiens
  Payload ID: 15568
  Gene Symbol: SERPINE3
  Gene Name: serpin peptidase inhibitor, clade E (nexin, plasminogen activator inhibitor type 1), member 3
  ENST ID: ENST00000419898
  CDS Start-End: 214-356
gacccacaagaacagagtcgagcaaggaaacgtgcaacagtgatacaaaagtctggctttgctaaagtcacacatccagtaagtggccgaagcagatcttcagacccacagtttggctgccaaaggaccacagtgagtatttctaatgctgaaacaagagggtgcagctctgcagcccagacggctgggcctcagggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagac

SEQ ID NO: 180583 - DNA, 1439 bp, Homo sapiens
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENST ID: ENST00000521255
  CDS Start-End: 61-1335
ccagcttccagcctaccctgcatctcttccctctgaattgcaggaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacaggtattacagtattttttgacaggattcagataatttatcagtgtctctctagcaacaagggctcatttgtccactatcccctcaaaaataagcattctttctagctgtttttatggtgcttcagaagctacccagttgctatcttctatcctaagaaaggggactatttcgtaagtacaaaggaaacttatcctccatgttttttacc

SEQ ID NO: 180584 - DNA, 2293 bp, Homo sapiens
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENST ID: ENST00000524365
  CDS Start-End: 626-1840
atcagatgcatgcatagcaccacacagctacatcttaaaaaacgtagtgtttactcaaaaacattagggaataacgaaatacataacataaaagcaggaggaggggggaagcattaggtacctggtacccagcaaaagcccaacaagcaaagttatcagtggaattcctcaatgtgacaaagggctggatgaggggttccttgctggtacaaccaggtcacaagcctaagaaggcttgacgggtgtggctggctctccccccacggccctgctctgttcccgatctgggctttgctgccctgggctgggctgcttctcctggctctctgcaggacctccaggctccaggaatttggaccgagtggtagagacatcgccggcagagacggcaatcgccagcttcctctctgtgctgtcttgtgattcaaagcagattctgctccacttttttaaaaggggagcacatgaatgctggagacccacaagaacagagtcgagcaaggaaacgtgcaacagtgatacaaaagtctggctttgctaaagtcacacatccagtaagtggccgaagcagatcttcagacccacagtttggctgccaaaggaccacagaaccctcccagcctccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacagggtttgtcttcagtattgggagagtttcaaatcccctagactaaatgcatgttctccactttcatcaatgcttttcttcataaagttataatttcattttgctatacccttgaaatttaaaaaaatgtctgataaagtgtaaaaagctaagggtatgtgattttcaatattataaacctaaaaatacttcagtttttaaatgttataagtttattttgcctactcttaatccaaatctattttgaccttcttttctactgcttaccccccaaaccactaaaaggcacagcagtgatcatgaatggtgagtgagtcaggccataagattgcttcctcagtacggatactctaggccatgttgaattgagggtggagaatgaatagcgtggttttccttatcctgtgaaactcaggggggatgcaaaatgagcaaagtcatcttaaaggtgtttcctttccatttagcttataaataaaacagagtttaagtgtgagaa

SEQ ID NO: 180585 - DNA, 1218 bp, Homo sapiens
  Payload ID: 15568
  Gene Symbol: SERPINE3
  Gene Name: serpin peptidase inhibitor, clade E (nexin, plasminogen activator inhibitor type 1), member 3
  Uniprot ID: A8MV23
  ENST ID: ENST00000400389
  CDS Start-End: 4-1218
tccatgccgcctttcctgatcaccctcttcctctttcactcttgctgcctccgagcaaatggccacctccgtgaaggaatgacattgctgaagactgagtttgcacttcacctctaccagagtgtggccgcgtgtagaaatgagacgaactttgtcatctctcctgctggtgtgtccctccccctggagatcctgcagtttggagcagaagggagcactggtcagcagctggcagatgccctggggtacactgtccatgacaaaagggtgaaagatttcttgcatgctgtttatgccacactacccacctccagccaaggcaccgagatggagctggcctgcagcctttttgtgcaagtgggaacgccactgtccccctgctttgtggagcacgtctcctggtgggctaacagcagcctggaaccagccgacctcagtgagcccaatagcaccgccatccagactagcgaaggggcctccagagagactgcaggtgggggccccagtgagggccctggtggctggccgtgggagcaagtcagtgcagcatttgctcagcttgtgcttgtgagcaccatgtccttccaaggcacttggcgaaagagattctcctccacagacacacagatcctgcctttcacctgtgcctatggcctcgtccttcaggtccccatgatgcaccaaacgaccgaggtcaactacggtcagttccaggacactgcaggccatcaggtgggggtgctggagcttccttacctgggaagtgcagtgagtctgttcctggtgctgccccgtgacaaagacacccccctgagccacatcgagccacacctcacagccagcaccatccacctctggaccaccagcctgaggagagccaggatggatgtgttcctgcccaggtttaggatccaaaatcaattcaacttaaaaagcattttaaattcttggggagtcaccgatctttttgatccactcaaagctaacttgaaaggaatttcaggccaagatggcttttatgtttctgaagcaatccacaaggccaagattgaagttttggaggaaggcaccaaggcatctggagccacagctctgttgttattgaaaaggtctcggattcctatttttaaagcagatcggccattcatctatttcctgagagaacctaacacagggtttgtcttcagtattgggagagtttcaaatcccctagactaa

SEQ ID NO: 180586 - DNA, 1548 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  Uniprot ID: P36955
  ENST ID: ENST00000254722
  CDS Start-End: 164-1420
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattcaccagactttagcaagatcacaggcaaacccatcaagctgactcaggtggaacaccgggctggctttgagtggaacgaggatggggcgggaaccacccccagcccagggctgcagcctgcccacctcaccttcccgctggactatcaccttaaccagcctttcatcttcgtactgagggacacagacacaggggcccttctcttcattggcaagattctggaccccaggggcccctaatatcccagtttaatattccaataccctagaagaaaacccgagggacagcagattccacaggacacgaaggctgcccctgtaaggtttcaatgcatacaataaaagagctttatccctaacttctgtta

SEQ ID NO: 180587 - DNA, 573 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000572048
  CDS Start-End: 276-573
gccagcagaagtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttga

SEQ ID NO: 180588 - DNA, 789 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000573770
  CDS Start-End: 55-399
ggcttagagggactaggctgggtgtggagctgcagcgtatccacaggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggcctgatgcctttaacctacttcaggaaaatctctaaggatgaaaattccttggccacctagattgtcttgaagatcagcctacttgggctctcagcagacaaaaaagatgagtatagtgtctgtgttctgggagggggcttgatttggggccctggtgtgcagttatcaacgtccacatccttgtctctggcaggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatc

SEQ ID NO: 180589 - DNA, 459 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000570731
  CDS Start-End: 64-459
gacaagggccgtccgagatgaaccctttctgctgcctgccaagccactgggaggggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccc

SEQ ID NO: 180590 - DNA, 731 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000577053
  CDS Start-End: 397-731
ggccaggtgtaatggctcacacctataaccctagcactttgggaggctgaagcaggtggatagcctgaggtcaggagtttgagacaagcctgatgaacgtggtgaaaccccatcgctattaaaatacaaaaaattagccgggcatggtggcaggtgcctgtaattccagctacttgggaggctgaggcgggagaatcgcttgaacccaggaggcggaggttgcagtgagccaagatcgctccactgtactccagcctgggcgacagagccagactctgtttcaaaaaataaaatataaataaataaataaataaataaataaataaaagctttaggcttaaaggagggtcccctgacgcagacagtggaacaaaagcacaagcttatggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgactt

SEQ ID NO: 180591 - DNA, 431 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000571149
  CDS Start-End: 171-431
aggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggccccaggatgcaggccctggtgctactcctctgcattggagccctcctcgggcacagcagctgccagaaccctgccagccccccggaggagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacg

SEQ ID NO: 180592 - DNA, 795 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000576406
  CDS Start-End: 524-795
ggcttagagggactaggctgggtgtggagctgcagcgtatccacagggctccccagaccccgacagcacaggggcgctggtggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccggatcgtctttgagaagaagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggggcagtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcct

SEQ ID NO: 180593 - DNA, 729 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000573763
  CDS Start-End: 316-729
gccagcagaagtcctggcaagtcacaggaagatgctggctgggaagtcagggcctgctgagcgctaaaccagaacccgagcctggcaggctctcaaagacgggatgcttgtcgtcgagtctcatacgctaacctctgctccgcctcttctcagagctgcgcataaaatccagctttgtggcacctctggaaaagtcatatgggaccaggcccagagtcctgacgggcaaccctcgcttggacctgcaagagatcaacaactgggtgcaggcgcagatgaaagggaagctcgccaggtccacaaaggaaattcccgatgagatcagcattctccttctcggtgtggcgcacttcaaggtgggtaacaaagtttgactccagaaagacttccctcgaggatttctacttggatgaagagaggaccgtgagggtccccatgatgtcggaccctaaggctgttttacgctatggcttggattcagatctcagctgcaagattgcccagctgcccttgaccggaagcatgagtatcatcttcttcctgcccctgaaagtgacccagaatttgaccttgatagaggagagcctcacctccgagttcattcatgacatagaccgagaactgaagaccgtgcaggcggtcctcactgtccccaagctgaagctgagttatgaaggcgaagtcaccaagtccctgcaggagatgaagctgcaatccttgtttgattca

SEQ ID NO: 180594 - DNA, 478 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000571360
  CDS Start-End: 94-478
aaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggaggaggaggatcctttcttcaaagtccccgtgaacaagctggcagcggctgtctccaacttcggctatgacctgtaccgggtgcgatccagcacgagccccacgaccaacgtgctcctgtctcctctcagtgtggccacggccctctcggccctctcgctgggagcggagcagcgaacagaatccatcattcaccgggctctctactatgacttgatcagcagcccagacatccatggtacctataaggagctccttgacacggtcactgccccccagaagaacctcaagagtgcctcccgga

SEQ ID NO: 180595 - DNA, 480 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000632188
  CDS Start-End: 397-480
ggccaggtgtaatggctcacacctataaccctagcactttgggaggctgaagcaggtggatagcctgaggtcaggagtttgagacaagcctgatgaacgtggtgaaaccccatcgctattaaaatacaaaaaattagccgggcatggtggcaggtgcctgtaattccagctacttgggaggctgaggcgggagaatcgcttgaacccaggaggcggaggttgcagtgagccaagatcgctccactgtactccagcctgggcgacagagccagactctgtttcaaaaaataaaatataaataaataaataaataaataaataaataaaagctttaggcttaaaggagggtcccctgacgcagacagtggaacaaaagcacaagcttatggccccaggatgcaggccctggtgctactcctctgcattggagccctcctcgggcacagcagctgccagaaccctgccagccccccggaggag

SEQ ID NO: 180596 - DNA, 247 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000633761
  CDS Start-End: 164-247
agtgcaggtcgctttaagaaaggagtagctgtaatctgaagcctgctggacgctggattagaaggcagcaaaaaaagctctgtgctggctggagccccctcagtgtgcaggcttagagggactaggctgggtgtggagctgcagcgtatccacaggccccaggatgcaggccctggtgctactcctctgcattggagccctcctcgggcacagcagctgccagaaccctgccagccccccggaggag

SEQ ID NO: 180597 - DNA, 254 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000632258
  CDS Start-End: 126-254
aggtaaagcagctccctggctgctctgatgccagggacggcgggagaggctcccctgggctggggggacaggggagaggcaggggcactccagggagcagaaaagaggggtgcaagggagaggaaatgcggagacagcagcccctgcaatttgggcaaaagggccccaggatgcaggccctggtgctactcctctgcattggagccctcctcgggcacagcagctgccagaaccctgccagccccccggaggag

SEQ ID NO: 180598 - DNA, 147 bp, Homo sapiens
  Payload ID: 15569
  Gene Symbol: SERPINF1
  Gene Name: serpin peptidase inhibitor, clade F (alpha-2 antiplasmin, pigment epithelium derived factor), member 1
  ENST ID: ENST00000632001
  CDS Start-End: 64-147
gacaagggccgtccgagatgaaccctttctgctgcctgccaagccactgggaggggccccaggatgcaggccctggtgctactcctctgcattggagccctcctcgggcacagcagctgccagaaccctgccagccccccggaggag

SEQ ID NO: 180599 - DNA, 2284 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENST ID: ENST00000324015
  CDS Start-End: 78-1553
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 180600 - DNA, 2265 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENST ID: ENST00000382061
  CDS Start-End: 56-1531
gggacttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctg

SEQ ID NO: 180601 - DNA, 838 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENST ID: ENST00000453723
  CDS Start-End: 45-838
ccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatca

SEQ ID NO: 180602 - DNA, 842 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENST ID: ENST00000453066
  CDS Start-End: 78-842
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttc

SEQ ID NO: 180603 - DNA, 1462 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENST ID: ENST00000450523
  CDS Start-End: 71-1354
agagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggccggcagctaactagcgggccgaaccaggagcaggtgtccccacttaccctcctcaagttgggcaaccaggtacaaccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctg

SEQ ID NO: 180604 - DNA, 2284 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENST ID: ENST00000618883
  CDS Start-End: 78-1553
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggctggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggc

SEQ ID NO: 180605 - DNA, 2265 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  Uniprot ID: P08697
  ENST ID: ENST00000622842
  CDS Start-End: 56-1531
gggacttgaaaaactggagcctgttcttggcaagaagattctaatgcccaggaacatggcgctgctctgggggctcctggtgctcagctggtcctgcctgcaaggcccctgctccgtgttctcccctgtgagcgccatggagcccttgggctggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctgagagaggccattctttcccaacacctcttggggagtttagggtggggggggggcgcggctgggaggagggcaggcatcggggagccgggagcctgaccctcatctttcttccaaacaggctcagagggtgtcctgcaccggggcctgggcaggagggaggtgcttctagttctgccaggagacaggttagctgctccccacgtcagctgggacaccccgacttttgtttaccagagaaaaagggagggggagagggctgcctttggacttgtcccgggacacctaggctagggtggggagagacgggccctggtggtggctcgggaggcgaagcgttgtcctcagccccgcgtggaactcgtgtctggcacagcctggctgtggcctaacctgccgagagtccatcagcctccatcctaccccctgtgccttgtcacgccagacttcccacggctcctcgagatcccaacactgccagcatttcccttccttcctctcctgtctccctcctctgcccgggagctcaggaaccgaggcagggaaggatcccatgagctccttaaggctcttttgtaaggtttttgtagtgatttttatgccacctgaataaagaatgaatgggcctg

SEQ ID NO: 180606 - DNA, 1462 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENST ID: ENST00000615103
  CDS Start-End: 71-1354
agagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggctggcagctaactagcgggccgaaccaggagcaggtgtccccacttaccctcctcaagttgggcaaccaggtacaaccaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatcagtccaccctggagctcagcgaggtcggcgtggaggcggcggcggccaccagcattgccatgtcccgcatgtccctgtcctccttcagcgtgaaccgccccttcctcttcttcatcttcgaggacaccacaggccttcccctcttcgtgggcagcgtgaggaaccccaaccccagtgcaccgcgggagctcaaggaacagcaggattccccgggcaacaaggacttcctccagagcctgaaaggcttcccccgcggagacaagcttttcggccctgacttaaaacttgtgccccccatggaggaggattacccccagtttggcagccccaagtgaggggccgtggctgtggcatccagagtccctgcctggaccagcctctccactcatgtgactctttccaaccggctttgtggcactggggcaggggccgggggcagtctg

SEQ ID NO: 180607 - DNA, 838 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENST ID: ENST00000631718
  CDS Start-End: 45-838
ccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggctggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtttctggaggaacaagtttgacccgagccttacccagagagactccttccacctggacgagcagttcacggtgcccgtggaaatgatgcaggcccgcacgtacccgctgcgctggttcttgctggagcagcctgagatccaggtggctcatttcccctttaagaacaacatgagctttgtggtccttgtacccacccactttgaatggaacgtgtcccaggtactggccaacctgagttgggacaccctgcacccacctctggtgtgggagaggcccaccaaggtccggctgcctaagctgtatctgaaacaccaaatggacctggtggccaccctcagccagctgggcctgcaggagttgttccaggccccagacctgcgtgggatctccgagcagagcctggtggtgtccggcgtgcagcatca

SEQ ID NO: 180608 - DNA, 842 bp, Homo sapiens
  Payload ID: 15570
  Gene Symbol: SERPINF2
  Gene Name: serpin peptidase inhibitor, clade F (alpha-2 antiplasmin, pigment epithelium derived factor), member 2
  ENST ID: ENST00000632520
  CDS Start-End: 78-842
cctgggcagagagtgaggagcacccaagtggggccagaggaacgttgtgtgtggcagcaaggagcccgcagaggaacatggcgctgctctgggggctcctggtgctcagctggtcctgcctgcaaggcccctgctccgtgttctcccctgtgagcgccatggagcccttgggctggcagctaactagcgggccgaaccaggagcaggtgtccccacttaccctcctcaagttgggcaaccaggagcctggtggccagactgccctgaagagtcccccaggagtctgcagcagagaccccaccccagagcagacccacaggctggcccgggccatgatggccttcactgccgacctgttctccctggtggctcaaacgtccacctgccccaacctcatcctgtcacccctgagtgtggccctggcgctgtctcacctggcactaggtgctcagaaccacacgttgcagaggctgcaacaggtgctgcacgcaggctcagggccctgcctcccccatctgctgagccgcctctgccaggacctgggccccggcgcgttccgactggctgccaggatgtacctgcagaaaggatttcccatcaaagaagatttcctggaacaatccgaacagctatttggggcaaagcccgtgagcctgacgggaaagcaggaagatgacctggcaaacatcaaccaatgggtgaaggaggccacggaggggaagattcaggaattcctctctgggctgccggaagacaccgtgttgcttctcctcaacgccatccacttccagggtttctggaggaacaagtttgacccgagccttacccagagagactccttc

SEQ ID NO: 180609 - DNA, 2002 bp, Homo sapiens
  Payload ID: 15571
  Gene Symbol: SERPING1
  Gene Name: serpin peptidase inhibitor, clade G (C1 inhibitor), member 1
  Uniprot ID: P05155
  ENST ID: ENST00000278407
  CDS Start-End: 228-1730
aagaagaccaagcggtcagtcccattccgtcccatcctgatttacaggaactcacaccagcgatcaatcttccttaatttgtaactgggcagtgtcccgggccagccaatagctaagactgccccccccgcaccccaccctccctgaccctgggggactctctactcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatgactttc

SEQ ID NO: 180610 - DNA, 1719 bp, Homo sapiens
  Payload ID: 15571
  Gene Symbol: SERPING1
  Gene Name: serpin peptidase inhibitor, clade G (C1 inhibitor), member 1
  ENST ID: ENST00000340687
  CDS Start-End: 63-1454
tcagtctgcactggagctgcctggtgaccagaagtttggagtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccat

SEQ ID NO: 180611 - DNA, 1733 bp, Homo sapiens
  Payload ID: 15571
  Gene Symbol: SERPING1
  Gene Name: serpin peptidase inhibitor, clade G (C1 inhibitor), member 1
  Uniprot ID: P05155
  ENST ID: ENST00000378323
  CDS Start-End: 58-1575
ctgcactggagctgcctggtgaccagaagtttggagtccgctgacgtcgccgcccagatggcctccaggctgaccctgctgaccctcctgctgctgctgctggctgggtttcttgaaccacaggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctg

SEQ ID NO: 180612 - DNA, 1751 bp, Homo sapiens
  Payload ID: 15571
  Gene Symbol: SERPING1
  Gene Name: serpin peptidase inhibitor, clade G (C1 inhibitor), member 1
  Uniprot ID: P05155
  ENST ID: ENST00000378324
  CDS Start-End: 139-1485
gcactggagctgcctggtgaccagaagtttggagatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaacctgacagaccatg

SEQ ID NO: 180613 - DNA, 2231 bp, Homo sapiens
  Payload ID: 15571
  Gene Symbol: SERPING1
  Gene Name: serpin peptidase inhibitor, clade G (C1 inhibitor), member 1
  ENST ID: ENST00000403558
  CDS Start-End: 367-1998
cccgccttcctgcccgccttgatctcgggggtctctataggcttgcttccacctgggacttctgcctcctcctaccccagcccctcccgcctcaggcctgttgtgctcagccccccaggacctcccctcccccacgcctctggcctcattgtttggttaaagcaggaccccctccccctcccaccacctcccctccgactgaacagatggacagagacccgggcccacggggagaggaagggccagccggtgccgggaaagggaagcggtttggggaaaacaaaacagagggaggagccagggagaaggtggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatgaagaaggtggagaccaacatggccttttccccattcagcatcgccagcctccttacccaggtcctgctcggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgagcaaccctcccacctcttccctctagccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttca

SEQ ID NO: 180614 - DNA, 648 bp, Homo sapiens
  Payload ID: 15571
  Gene Symbol: SERPING1
  Gene Name: serpin peptidase inhibitor, clade G (C1 inhibitor), member 1
  ENST ID: ENST00000405496
  CDS Start-End: 168-648
atgctgtttttattgttactcatgaagacgcgggggaagctttggttgtgtaaagctgagaactgcacccaagcttccccgttcaccccacctaccaggggatttgggctaaattcctggcctggcccacaaagaagaccaagcggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagcccactactgggtccttctgcccaggacctgttactctctgctctgacttggagagtcattcaacagaggccgtgttgggggatgctttggtagatttctccctgaagctctaccacgccttctcagcaatga

SEQ ID NO: 180615 - DNA, 569 bp, Homo sapiens
  Payload ID: 15571
  Gene Symbol: SERPING1
  Gene Name: serpin peptidase inhibitor, clade G (C1 inhibitor), member 1
  ENST ID: ENST00000457869
  CDS Start-End: 203-569
actcagtctgcactggagctgcctggtgaccagaagtttggaatggacagagacccgggcccacggggagaggaagggccagccggtgccgggaaagggaagcggtttggggaaaacaaaacagagggaggagccagggagaaggtggccccaggagggaggaggagggaattcgctaagagggactggggcctgagacggaatgggggcgggccccgggcggggtgggggcccctgggctcccagggtgggagctggctccgaggctggctggctccgcaggtccgctgacgtcgccgcccagatggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacac

SEQ ID NO: 180616 - DNA, 956 bp, Homo sapiens
  Payload ID: 15571
  Gene Symbol: SERPING1
  Gene Name: serpin peptidase inhibitor, clade G (C1 inhibitor), member 1
  ENST ID: ENST00000528996
  CDS Start-End: 1-261
gccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaagccttggccaaggcagacattgtatattttaggctggaaacaggattctcaagtttcttcatgcatctctactatattgaatggcaaaatgtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccactttttgcagctttctctagttcaagttcaccagactctataaataaaa

SEQ ID NO: 180617 - DNA, 907 bp, Homo sapiens
  Payload ID: 15571
  Gene Symbol: SERPING1
  Gene Name: serpin peptidase inhibitor, clade G (C1 inhibitor), member 1
  ENST ID: ENST00000531797
  CDS Start-End: 39-170
ctggctggctccgcaggtccgctgacgtcgccgcccagatggcctccaggctgaccctgctgaccctcctgctgctgctgctggctggggggctggggagaacaccaaaacaaacctggagagcatcctctcttaccccaaggacttcacctgtgtccaccaggccctgaagggcttcacgaccaaaggtgtcacctcagtctctcagatcttccacagcccaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctgagacctgcaggatcaggttagggcgagcgctacctctccagcctcagctctcagttgcagccctgctgctgcctgcctggacttggcccctgccacctcctgcctcaggtgtccgctatccaccaaaagggctccctgagggtctgggcaagggacctgcttctattagcccttctccatggccctgccatgctctccaaaccacttttt

SEQ ID NO: 180618 - DNA, 1004 bp, Homo sapiens
  Payload ID: 15571
  Gene Symbol: SERPING1
  Gene Name: serpin peptidase inhibitor, clade G (C1 inhibitor), member 1
  ENST ID: ENST00000531133
  CDS Start-End: 1-132
atggcctccaggctgaccctgctgaccctcctgctgctgctgctggctggggggctggggagaacaccaaaacaaacctggagagcatcctctcttaccccaaggacttcacctgtgtccaccaggccctgaagggcttcacgaccaaaggtgtcacctcagtctctcagatcttccacagcccagacctggccataagggacacctttgtgaatgcctctcggaccctgtacagcagcagccccagagtcctaagcaacaacagtgacgccaacttggagctcatcaacacctgggtggccaagaacaccaacaacaagatcagccggctgctagacagtctgccctccgatacccgccttgtcctcctcaatgctatctacctgagtgccaagtggaagacaacatttgatcccaagaaaaccagaatggaaccctttcacttcaaaaactcagttataaaagtgcccatgatgaatagcaagaagtaccctgtggcccatttcattgaccaaactttgaaagccaaggtggggcagctgcagctctcccacaatctgagtttggtgatcctggtaccccagaacctgaaacatcgtcttgaagacatggaacaggctctcagcccttctgttttcaaggccatcatggagaaactggagatgtccaagttccagcccactctcctaacactaccccgcatcaaagtgacgaccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctga

SEQ ID NO: 180619 - DNA, 634 bp, Homo sapiens
  Payload ID: 15571
  Gene Symbol: SERPING1
  Gene Name: serpin peptidase inhibitor, clade G (C1 inhibitor), member 1
  ENST ID: ENST00000619430
  CDS Start-End: 1-402
atggcctccaggctgaccctgctgaccctcctgctgctgctgctggctggggatagagcctcctcaaatccaaatgctaccagctccagctcccaggatccagagagtttgcaagacagaggcgaagggaaggtcgcaacaacagttatctccaagatgctattcgttgaacccatcctggaggtttccagcttgccgacaaccaactcaacaaccaattcagccaccaaaataacagctaataccactgatgaacccaccacacaacccaccacagagcccaccacccaacccaccatccaacccacccaaccaactacccagctcccaacagattctcctacccagccaggatatgctctcaatcatggagaaattggaattcttcgatttttcttatgaccttaacctgtgtgggctgacagaggacccagatcttcaggtttctgcgatgcagcaccagacagtgctggaactgacagagactggggtggaggcggctgcagcctccgccatctctgtggcccgcaccctgctggtctttgaagtgcagcagcccttcctcttcgtgctctgggaccagcagcacaagttccctgtcttcatggggcgagtatatgaccccagggcctga

SEQ ID NO: 180620 - DNA, 2225 bp, Homo sapiens
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENST ID: ENST00000358171
  CDS Start-End: 269-1525
agagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 180621 - DNA, 474 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000526242
  CDS Start-End: 218-474
tttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcct

SEQ ID NO: 180622 - DNA, 582 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000533449
  CDS Start-End: 131-582
aatttgagcttccggtggtgggaaaggaggtgaaatcgtctcgactcctgggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaa

SEQ ID NO: 180623 - DNA, 587 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000528990
  CDS Start-End: 93-587
tgagggaatttgagcttccggtggtgggaaaggaggtgaaatcgtctcgactcctggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgac

SEQ ID NO: 180624 - DNA, 2283 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000525876
  CDS Start-End: 979-1584
gagtacctccatagacaacactattctcacagtttgctgtgagaatgaagtaaccctcgttttacaaatgaggccaagctaggagagctgaggtctccccgagtcagtggctgagcttggattggaacacaggtctggctgtgagcaagggcagggttcaggccactctcagacattttttgttgttattttctggtcatggagacagaacttgcagaggaaaacgaagggtgggctgagcacagtagctcatgcctgtaatcctagcactttgggaggccaaggtgggtggatcacatgagcccaggaatttgagaccagcctgggtaagatggcgaaaccccatgtctacaaaaaattagccaggcgtggtggcgcatgctggtagtcccagctactctggaggctgaggtgggaggatcgctggagcctgggaattcaagactgcagtgtgtcatgattgtaccactgcactccagctgtaggatggagtgggacggaccttgtctcaaaaagaaaaagataaaaaaaaaattaagggtggtcatggggcactccctgcccagggcacagctgtcccccaggtaccagggagggtagaaagcccacctcagagcatgtttccaaaatatctgacaagtgctagagccgggggtggccatagaggtggctgacctgagggcggaattaattctctatcatatgggagcagcaggcactgactgtagggaaccgcatcctcagatggcatgtcctggggccaagaccccttcccaaagctgggaacatagactctgtgggctgggtgctctatagctgggccctgaagaatggagcaaagacctgtggcaaggataaatcaaggtctgcagccgggggtggctgtgggctgtgattgtgtttgggggcggccatgtgtctctgaccctgtgttttgccccaactacagcacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgac

SEQ ID NO: 180625 - DNA, 3391 bp, Homo sapiens
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENST ID: ENST00000524558
  CDS Start-End: 1436-2692
aatctgggggtgcgcgagggagtaagaggggcgaggggaccctgcgaagcgttgggtgccgagccagagcctacaaattggagtcctcggcactttgggggccgctggagggtttggaatcgagagcccagggctagccagtgatggtgccagctgagggctagggcggagatcggagccgggttgggagtccgtgcactcggaggactgggaaaaagtgcagggacccctaaaaggtggtggtggcagatacgagactaggtgctgtgtaaagggggctgggggcagagagcagagcctctgcggaaagaaacagaggaggaaggagatgggtctggtgcctcttcccgcaagggtagggaggataggccggcctcgcagttccaggtcacttccgttctggggttgaggctcaggggcagcggtgattggtggcccagcctcctcacaggcttgctgagggaatttgagcttccggtggtgggaaaggaggtgaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtgggggtcagcagggtctgctctgctctggggattaaggggctgactagaaggatttgagtctttccttctgtccactgccacagggttcttggagtaactgcagggtttaaactgcagggtctaacttccagaggctggggttccctgccccccagcttagagacattcctgaggtggctgaagagcaggaaggagaatgaatgcacttccagactggcccagagtctcagcccctcctcttccttgtttcccgctggtccctctgggctgtacggcccggatggaggcctgaggaaaatgagggggctttggttctccggaattccggccggggccacaccctcctgtcttcagatggttcatgtacccatccccccttcccgtcctctcctttgtctcctctgtcaccgggactcccagcagagattttttttttgtactggctgtgtaacaggacaccgcatgcagccctcaggaggggctctgtgcttctgtgaggaaggacccctgtgctgggaaggcagacccctgtttatcccgagggacctggggtgaccccctgccctggccttgtttctcccattttacagtgaggtggtcgatctccaaggtccctgtagattggggactggttgtgccctctgcgccaggggcctcctcaccatctctcctttgccggctcccgccctcttcactcttctgttttctttcagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgac

SEQ ID NO: 180626 - DNA, 529 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000525492
  CDS Start-End: 102-529
aagagtagaatcgtgtcgcggctcgagagcgagagtcacgtcccggcgctagcccagcccgacccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaa

SEQ ID NO: 180627 - DNA, 2299 bp, Homo sapiens
  Payload ID: 15572
  Gene Symbol: SERPINH1
  Gene Name: serpin peptidase inhibitor, clade H (heat shock protein 47), member 1, (collagen binding protein 1)
  Uniprot ID: P50454
  ENST ID: ENST00000533603
  CDS Start-End: 343-1599
agtaggacccaggggccgggaggcgccggcagagggaggggccgggggccggggaggttttgagggaggtctttggctttttttggcggagctggggcgccctccggaagcgtttccaactttccagaagtttctcgggacgggcaggagggggtggggactgccatatatagatcccgggagcaggggagcgggctaagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcagaaacacctggctgggctgggcctgactgaggccattgacaagaacaaggccgacttgtcacgcatgtcaggcaagaaggacctgtacctggccagcgtgttccacgccaccgcctttgagttggacacagatggcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccaggtaccttctcacctgtgagaccaaattgagctaggggggtcagccagccctcttctgacactaaaacacctcagctgcctccccagctctatcccaacctctcccaactataaaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 180628 - DNA, 882 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000526397
  CDS Start-End: 134-882
ggagcgggctaagagtagaatcgtgtcgcggctcgagagcgagagtcacgtcccggcgctagcccagcccgacccaggtgaggggcgggagacgcctgcgcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaa

SEQ ID NO: 180629 - DNA, 974 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000525611
  CDS Start-End: 232-974
gaaatcgtctcgactcctggggtccgtgtgctctggtagaagtgggcgacagtggctcaatttctgatcagcagcttgcagcctagatgatggcagccaaaggaaagacttggccagcgaggctccctaccactccgaaaaaagagagtggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacga

SEQ ID NO: 180630 - DNA, 660 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000529643
  CDS Start-End: 161-660
aagagtagaatcgtgtcgcggctcgagagcgagagtcacgtcccggcgctagcccagcccgacccaggtgaggggcgggagacgcctgcgtgcgtgcggcccgggggagcgccgagcaatctgggggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcg

SEQ ID NO: 180631 - DNA, 998 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000532356
  CDS Start-End: 112-998
gtgcggcccgggggagcgccgagcaatctggggaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaa

SEQ ID NO: 180632 - DNA, 1358 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000530284
  CDS Start-End: 146-1120
aagagtagaatcgtgtcgcggctcgagagcgagagtcacgtcccggcgctagcccagcccgacccagaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgccatgttcttcaagccacactgggatgagaaattccaccacaagatggtggacaaccgtggcttcatggtgactcggtcctataccgtgggtgtcatgatgatgcaccggacaggcctctacaactactacgacgacgagaaggaaaagctgcaaatcgtggagatgcccctggcccacaagctctccagcctcatcatcctcatgccccatcacgtggagcctctcgagcgccttgaaaagctgctaaccaaagagcagctgaagatctggatggggaagatgcagaagaaggctgttgccatctccttgcccaagggtgtggtggaggtgacccatgacctgcaggtaaggggtggcccagcctaggggcctgcaggccttggagccagggggaggtgcttgggggacccactcaccaattcagcaggtctgtcccaagaccccctggatgtccaggcagtgctgggctctgtgatgggggaagctggggcaggaggtgtgggccatgcccttgggaagatgatgataataccagcagctaaatataacggaacattcctgtatgctaggcgttcttctaagcactttatatgtattattatta

SEQ ID NO: 180633 - DNA, 719 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000526638
  CDS Start-End: 1-170
gcaacccctttgaccaggacatctacgggcgcgaggagctgcgcagccccaagctgttctacgccgaccaccccttcatcttcctagtgcgggacacccaaagcggctccctgctattcattgggcgcctggtccggcctaagggtgacaagatgcgagacgagttatagggcctcagggtgcacacaggatggcaggaggcatccaaaggctcctgagacacatgggtgctattggggttgggggggaggtgaggtaccagccttggatactccatggggtgggggtggaaaaacagaccggggttcccgtgtgcctgagcggaccttcccagctagaattcactccacttggacatgggccccagataccatgatgctgagcccggaaactccacatcctgtgggacctgggccatagtcattctgcctgccctgaaagtcccagatcaagcctgcctcaatcagtattcatatttatagccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacattttttttttcaataaaacttttccaatgaca

SEQ ID NO: 180634 - DNA, 773 bp, Homo sapiens
  Payload ID: 15572
  Gene Symbol: SERPINH1
  Gene Name: serpin peptidase inhibitor, clade H (heat shock protein 47), member 1, (collagen binding protein 1)
  ENST ID: ENST00000528760
  CDS Start-End: 164-773
cgggactcccagcagagattttttttttgtactggctgtgtaacaggacaccgcatgcagccctcaggaggggctctgtgcttctaatgaaaaaggcaggcattgacctccctctgaggcagtttccaggcccaccgtggtgcacgcaaaccacttcctggccatgcgctccctcctgcttctcagcgccttctgcctcctggaggcggccctggccgccgaggtgaagaaacctgcagccgcagcagctcctggcactgcggagaagttgagccccaaggcggccacgcttgccgagcgcagcgccggcctggccttcagcttgtaccaggccatggccaaggaccaggcagtggagaacatcctggtgtcacccgtggtggtggcctcgtcgctagggctcgtgtcgctgggcggcaaggcgaccacggcgtcgcaggccaaggcagtgctgagcgccgagcagctgcgcgacgaggaggtgcacgccggcctgggcgagctgctgcgctcactcagcaactccacggcgcgcaacgtgacctggaagctgggcagccgactgtacggacccagctcagtgagcttcgctgatgacttcgtgcgcagcagcaagcagcactacaactgcgagcactccaagatcaacttccgcgacaagcgcagcgcgctgcagtccatcaacgagtgggccgcgcagaccaccgacggcaagctgcccgaggtcaccaaggacgtggagcgcacggacggcgccctgctagtcaacgcca

SEQ ID NO: 180635 - DNA, 1907 bp, Homo sapiens
  Payload ID: 15573
  Gene Symbol: SERPINI1
  Gene Name: serpin peptidase inhibitor, clade I (neuroserpin), member 1
  Uniprot ID: Q99574
  ENST ID: ENST00000295777
  CDS Start-End: 432-1664
agtttcccgggagagacgaaagcaggaacgagagcggagcggagcacagtccgccgagcacaagctccagcatcccgtcaggggttgcaggtgtgtgggaggtaagcgtgggtccttcttcggggcgtctgcactgccctggagaaaacgtcttccaataggaattacatcaagacacagctaaaagagtccgcgttgggttaggaaaccggtgcaaaacctctcgggtgaaagatttacatttttcgactttaagggcaaaaaagcaaaaggaagcttgactctgggtataaagggcgtggttagtgtttttggtttgagttgcaccagtaaaactgttctgggagatctgaagattgagaaaaatcctgctaattgaggacgaggtggatgttatctggtggatgttataggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatg

SEQ ID NO: 180636 - DNA, 1890 bp, Homo sapiens
  Payload ID: 15573
  Gene Symbol: SERPINI1
  Gene Name: serpin peptidase inhibitor, clade I (neuroserpin), member 1
  Uniprot ID: Q99574
  ENST ID: ENST00000446050
  CDS Start-End: 413-1645
gaaggataggctgagccggggctcccagcagagacgcctgggtggggcaggaggccgctccaggtgtgagccacagaggaggggagagggacccccacgggagtggaagtggcagagcagctgcagaagtgcagggagcggaaaggtaccagggcagctgctttccgctgcctccggtccgggcagctgcagaaacagcagggggaggagcaacagctgccaaattcgccaactagaggagggagaggcggagcttgggtccctgtagaagccagaggcgcagtctggactgtagtttcccgggagagacgaaagcaggaacgagagcggagcggagcacagtccgccgagcacaagctccagcatcccgtcaggggttgcaggtgtgtgggaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccatatgaaggagatgaaataagcatgatgctggtgctgtccagacaggaagttcctcttgctactctggagccattagtcaaagcacagctggttgaagaatgggcaaactctgtgaagaagcaaaaagtagaagtatacctgcccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattgaacatgtg

SEQ ID NO: 180637 - DNA, 582 bp, Homo sapiens
  Payload ID: 15573
  Gene Symbol: SERPINI1
  Gene Name: serpin peptidase inhibitor, clade I (neuroserpin), member 1
  ENST ID: ENST00000472941
  CDS Start-End: 102-582
gaggggcctgtggtggggatcctggggctgtcgggctgagtatgccgtgtgggtggagaggaagcctcggggaaatcgcccaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaaca

SEQ ID NO: 180638 - DNA, 842 bp, Homo sapiens
  Payload ID: 15573
  Gene Symbol: SERPINI1
  Gene Name: serpin peptidase inhibitor, clade I (neuroserpin), member 1
  ENST ID: ENST00000472747
  CDS Start-End: 107-842
tttcccgggagagacgaaagcaggaacgagagcggagcggagcacagtccgccgagcacaagctccagcatcccgtcaggggttgcaggcttgaaactgttacaatatggctttccttggactcttctctttgctggttctgcaaagtatggctacaggggccactttccctgaggaagccattgctgacttgtcagtgaatatgtataatcgtcttagagccactggtgaagatgaaaatattctcttctctccattgagtattgctcttgcaatgggaatgatggaacttggggcccaaggatctacccagaaagaaatccgccactcaatgggatatgacagcctaaaaaatggtgaagaattttctttcttgaaggagttttcaaacatggtaactgctaaagagagccaatatgtgatgaaaattgccaattccttgtttgtgcaaaatggatttcatgtcaatgaggagtttttgcaaatgatgaaaaaatattttaatgcagcagtaaatcatgtggacttcagtcaaaatgtagccgtggccaactacatcaataagtgggtggagaataacacaaacaatctggtgaaagatttggtatccccaagggattttgatgctgccacttatctggccctcattaatgctgtctatttcaaggggaactggaagtcgcagtttaggcctgaaaatactagaaccttttctttcactaaagatgatgaaagtgaagtccaaattccaatgatgtatcagcaaggagaattttattatggggaatttagtgatggctccaatgaagctggtggtatctaccaagtcctagaaataccat

SEQ ID NO: 180639 - DNA, 595 bp, Homo sapiens
  Payload ID: 15573
  Gene Symbol: SERPINI1
  Gene Name: serpin peptidase inhibitor, clade I (neuroserpin), member 1
  ENST ID: ENST00000466865
  CDS Start-End: 1-358
ctccaggttcacagtggaacaggaaattgatttaaaagatgttttgaaggctcttggaataactgaaattttcatcaaagatgcaaatttgacaggcctctctgataataaggagatttttctttccaaagcaattcacaagtccttcctagaggttaatgaagaaggctcagaagctgctgctgtctcaggaatgattgcaattagtaggatggctgtgctgtatcctcaagttattgtcgaccatccatttttctttcttatcagaaacaggagaactggtacaattctattcatgggacgagtcatgcatcctgaaacaatgaacacaagtggacatgatttcgaagaactttaagttactttatttgaataacaaggaaaacagtaactaagcacattatgtttgcaactggtatatatttaggatttgtgttttacagtatatcttaagataatatttaaaatagttccagataaaaacaatatatgtaaattataagtaacttgtcaaggaatgttatcagtattaagctaatggtcctgttatgtcattgtgtttgtgtgctgttgtttaaaataaaagtacctattg

SEQ ID NO: 180640 - DNA, 1678 bp, Homo sapiens
  Payload ID: 15574
  Gene Symbol: SERPINI2
  Gene Name: serpin peptidase inhibitor, clade I (pancpin), member 2
  Uniprot ID: O75830
  ENST ID: ENST00000264677
  CDS Start-End: 141-1358
aggaattaatcaagcaatggtcaagataaatggagttggccttgatcgctcaggtgtttatgtacaagagttttccagcaagcgtattttagttgtaacattccagtgaataatcagaagtcagtttgggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 180641 - DNA, 1514 bp, Homo sapiens
  Payload ID: 15574
  Gene Symbol: SERPINI2
  Gene Name: serpin peptidase inhibitor, clade I (pancpin), member 2
  Uniprot ID: O75830
  ENST ID: ENST00000461846
  CDS Start-End: 102-1319
aagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttag

SEQ ID NO: 180642 - DNA, 743 bp, Homo sapiens
  Payload ID: 15574
  Gene Symbol: SERPINI2
  Gene Name: serpin peptidase inhibitor, clade I (pancpin), member 2
  ENST ID: ENST00000466903
  CDS Start-End: 126-743
tgaataatcagaagtcagtttgggaagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaa

SEQ ID NO: 180643 - DNA, 477 bp, Homo sapiens
  Payload ID: 15574
  Gene Symbol: SERPINI2
  Gene Name: serpin peptidase inhibitor, clade I (pancpin), member 2
  ENST ID: ENST00000467583
  CDS Start-End: 6-477
tcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctgagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggcc

SEQ ID NO: 180644 - DNA, 1331 bp, Homo sapiens
  Payload ID: 15574
  Gene Symbol: SERPINI2
  Gene Name: serpin peptidase inhibitor, clade I (pancpin), member 2
  Uniprot ID: O75830
  ENST ID: ENST00000471111
  CDS Start-End: 70-1287
gagctctctgtggaaaactctattttgaaaatgaatatattttgatttaaacaatacagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaata

SEQ ID NO: 180645 - DNA, 1837 bp, Homo sapiens
  Payload ID: 15574
  Gene Symbol: SERPINI2
  Gene Name: serpin peptidase inhibitor, clade I (pancpin), member 2
  Uniprot ID: O75830
  ENST ID: ENST00000476257
  CDS Start-End: 300-1517
ttttgtagctttgaaagctgtatttgatgagaaaaacctgtttcccaaggaaattctgcatcatgaacgaaaagccaagcaattatgccaagaaaaaagttgtgaagtgaagaaaaataagaagtaattacaacagaaaaaccttcactgttacataagaggaattaatcaagcaatggtcaagataaatggagttggccttgatcgctcaggtgtttatgtacaagagttttccagcaagcgtattttagttgtaacattccagtgaataatcagaagtcagtttgggagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 180646 - DNA, 1769 bp, Homo sapiens
  Payload ID: 15574
  Gene Symbol: SERPINI2
  Gene Name: serpin peptidase inhibitor, clade I (pancpin), member 2
  ENST ID: ENST00000616363
  CDS Start-End: 202-1449
aggaattaatcaagcaatggtcaagataaatggagttggccttgatcgctcaggtgtttatgtacaagagttttccagcaagcgtattttagttgtaacattccagtgaataatcagaagtcagtttgggaagatccagttcttataggactattcatcaggttgtttagttcagcattactttgtgctttctgataagatatgatccaaaacctgatgagagaagtcaaaatggacacaatcttcttgtggagtcttctattgctgttttttggaagtcaagcctcaagatgctcagctcaaaaaaataccgaatttgcagtggatctttatcaagaggtttccttatctcataaggacaacattatattttcaccccttggaataactttggttcttgagatggtacaactgggagccaaaggaaaagcacagcagcagataagacaaactttaaaacaacaggaaacctcagctggggaagaattttttgtactgaagtcatttttctctgccatctcagagaaaaaacaagaatttacatttaatcttgccaatgccctctaccttcaagaaggattcactgtgaaagaacagtatctccatggcaacaaggaattttttcagagtgctataaaactggtggattttcaagatgcaaaggcttgtgcagagatgataagtacctgggtagaaagaaaaacagatggaaaaattaaagacatgttttcaggggaagaatttggccctctgactcggcttgtcctggtgaatgctatttatttcaaaggagattggaaacagaaattcagaaaagaggacacacagctgataaattttactaagaaaaatggttcaactgtcaaaattccaatgatgaaggctcttctgagaacaaaatatggttatttttctgaatcttccctgaactaccaagttttagaattgtcttacaaaggtgatgaatttagcttaattatcatacttcctgcagaaggtatggatatagaagaagtggaaaaactaattactgctcaacaaatcctaaaatggctctctgagatgcaagaagaggaagtagaaataagcctccctagatttaaagtagaacaaaaagtagacttcaaagacgttttgtattctttgaacataaccgagatatttagtggtggctgcgacctttctggaataacagattcatctgaagtgtatgtttcccaagtgacgcaaaaagttttctttgagataaatgaagatggtagtgaagctgcaacatcaactggcatacacatccctgtgatcatgagtctggctcaaagccaatttatagcaaatcatccatttctgtttattatgaagcataatccaacagaatcaattctgtttatgggaagagtgacaaatcctgacacccaggagataaaaggaagagatttagattcactgtgaatgaaaagcacagcctcagaataaaagatgatttctcaaaaatagctgattggcaaaatatcgtcatcttgacaatatttgctctatatcttatgtcttttctgttttaaactgtgcctgtagtaatagatatctgtcttgatgaataagtaaaattaggtatgcatttgtttccattccttctgtatgttttagaaaatctatatgcatctaaaaccttgagcgtacgtaaaatattaccattcatatgttagaacaatcctgtctataatatcttaaataccaaattcttgtcttagatagcaaatttattattccct

SEQ ID NO: 180647 - DNA, 2103 bp, Homo sapiens
  Payload ID: 15575
  Gene Symbol: SERBP1
  Gene Name: SERPINE1 mRNA binding protein 1
  Uniprot ID: Q8NC51
  ENST ID: ENST00000361219
  CDS Start-End: 100-1281
tctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcac

SEQ ID NO: 180648 - DNA, 1621 bp, Homo sapiens
  Payload ID: 15575
  Gene Symbol: SERBP1
  Gene Name: SERPINE1 mRNA binding protein 1
  Uniprot ID: Q8NC51
  ENST ID: ENST00000370990
  CDS Start-End: 73-1281
gctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtt

SEQ ID NO: 180649 - DNA, 6676 bp, Homo sapiens
  Payload ID: 15575
  Gene Symbol: SERBP1
  Gene Name: SERPINE1 mRNA binding protein 1
  Uniprot ID: Q8NC51
  ENST ID: ENST00000370994
  CDS Start-End: 116-1279
gaagacggcccccctctctcggcccggccatcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatctggcctgaagcacgaggacaaacgtggaggtagcggatctcacaactggggaactgtcaaagacgaattaactgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcataaaaacaatcaaataggatcatgtttattgtcatgtgtttcctggtttctgacctgtgtgcacacccctgtgtgtttataatttttaaattgaattttatatggggtttttatttgctaaaaaccaggctgttgaatcacatttgggaagggtacttatcttaatgactaatgacttaattgggaaagttgaattcttgtaaaatacaaaatccaaggacttcttggatttaatctgattgtcacttcttagcagatcacttttttgataatgaaagttaagcatactgaatgctacttttgattgacaaactggctataatagtctaggggaaaaatccctaaacagataaagattcctaaagtaatggtggcagctgatgtttcagtgaacttttatcttgatgcgtttaaatggaagtaatgccagacctgagatttttaaggcatttttacagcttgtattgaaatgattggagacatggtttctttattagctattttgagacctgtggagttaagcaagacttttaaaaattggcaccatatacatctagttagttcctttactcttatttttttaaataaaagtagtacacatcatttccagggttgtaaatatatttggggcttgtttttggtatggatttaaaaggaggatattaagtattcattctaattttgttatttttctagttgccagagatggttgcactgaaatagaacagggagttgcatacaaagcctaaatgtgtattggatttcgaaaatactaggttggtgcaattggttttgtaccaacctaacatgtctttaggaaagtaccatcatgtggaaggaaacaacaggtgttaaaaggttcaaaggaatgagaaataggaagttactagaacctaactgatgttgaccttagaggtaagattattcaggtatattagtggacctccagtccaatggtatagcaaattccagggatctcaggtgcatgcaattttactttctaaagtaaacacttagaaaatagattataacccagacgttttggattatactgagacaaatatgtaaataagttttagcaagtctgaacatgtaccagcgagatcttcaggttaactaagaaaagcccagaaacttcattatttactgtgctttgtatggcataactggtaacaaggcagtaaaatgatacatatttgaactggaccatagtaattaaatgatttatcaatatcatttgcaagataattgtcaggttgagttaatagtaagtggcagcttcccagaaatttgggttatttggcctaagctgtgccctgggattacctcttcatcttccttgacttttaagttcaaatttggaggttatgtgaagtgattgaaataaatctttcaggctgaggaagtcggtaatttcaagaatatagtgaaaacaaggttgtaatctaaacatgagaagcttaagtttaggaaatggttagaatataaattgctaaagccatcatgattttggccacagatgaaaatatgaacactggaaatgagcgccatttaaatgagatgctgtatgtaagccaggggtcagcaaagttcagcctgtgacctggtgtgtgtgggggtgtgtgtgtgtgtgtgtgtgtgtgtgtgtgtgtccgtgtccctgagttaagaatggtttttaggcttgtataggattaaaaaaaaaaaaaacccacagaaaaatgtaggcagcccagcataagataccgcctttcacagaaatgtttgctgaccccggaactgtcactctcgggttacaagagtttgtttctttgaaacagtctggctctgtcacccaggctggagtgcagtggcatgatctcaggtcactgcagcctccacctcccgggttcaagcaattctgcctcagcctcctgagtagctgggattacaggtgtgcaccaccacagacagctaattttacaggtgtacaccaccacacccaagaatcacttgaacccgggaggtgggggttgcagtgagccaagatcatagcactgtactccagtctgggtgacacactgtctgaaaaataaaagtttagttctaggtacaaattaagtggtctacccaacaggaagctgtgaaattagaagtaattttaaagcatactttacacctctatataatcaaagtaagggcaagataaaacttgttagtaaaacatgttttattattttttagataggtagcctgcaacataaaatatattttgaaagctgttaaggggtgtataatctgttaaaaaataccatgattagtatttcacatttagtgactcagatccctttgtgtaagtcctttgcgttgtgcaaagaggtttttctatgagatgagaattatgaacacttcatataggtaaattccataggttgagctggggcagaaattaatggctcctggagattgcatctttttttttttttttttgagcttagaattcccatttggacagaatttagcttttgtgctgttgattacttctgtactaaactggtagccaattgttcacttctaaatggaagggaaaaagttacccacacaagttagaaaatgatttaccgaattatttttttgagttagtatgtatatactgttttaaatcagtaatgtttgttccttttgctgcccatttgggagtatgtggcaattcctagtgctcttgtatgacattactcttcttgagacttgtatatgcaagaaagtatatataaaagatgcctggtggtaactttgtatctgagttctgattcattatggacttttagaaatctatttagataattggttcatactaggtgctcaattactctgaccttgtgtggcttaatccttaaatagttgctttaggtgttactgggtggaagcatggaaagtgaagggctaatattaaggatttttatgtattactgagtagggaaagtgggaagtagcttatctttggacagttgtattactttgcactaatcaccttgtttgcagttgtagctgattcagttctagattttaggaccaaaaagatctctaatttaaagaaacagtttttatatacctagaatgaagattctgtttaaagcggttttggttaacttggttcttgacatttgcctaaaattttgttggattgggactaaaatgttctattagccaatgaataacgtccaagtaaatttttgttttattttgggaa

SEQ ID NO: 180650 - DNA, 3482 bp, Homo sapiens
  Payload ID: 15575
  Gene Symbol: SERBP1
  Gene Name: SERPINE1 mRNA binding protein 1
  Uniprot ID: Q8NC51
  ENST ID: ENST00000370995
  CDS Start-End: 87-1313
atcttgtgggaagagctgaagcaggcgctcttggctcggcgcggcccgctgcaatccgtggaggaacgcgccgccgagccaccatcatgcctgggcacttacaggaaggcttcggctgcgtggtcaccaaccgattcgaccagttatttgacgacgaatcggaccccttcgaggtgctgaaggcagcagagaacaagaaaaaagaagccggcgggggcggcgttgggggccctggggccaagagcgcagctcaggccgcggcccagaccaactccaacgcggcaggcaaacagctgcgcaaggagtcccagaaagaccgcaagaacccgctgccccccagcgttggcgtggttgacaagaaagaggagacgcagccgcccgtggcgcttaagaaagaaggaataagacgagttggaagaagacctgatcaacaacttcagggtgaagggaaaataattgatagaagaccagaaaggcgaccacctcgtgaacgaagattcgaaaagccacttgaagaaaagggtgaaggaggcgaattttcagttgatagaccgattattgaccgacctattcgaggtcgtggtggtcttggaagaggtcgagggggccgtggacgtggaatgggccgaggagatggatttgattctcgtggcaaacgtgaatttgataggcatagtggaagtgatagatcttctttttcacattacagtggcctgaagcacgaggacaaacgtggaggtagcggatctcacaactggggaactgtcaaagacgaattaacagagtcccccaaatacattcagaaacaaatatcttataattacagtgacttggatcaatcaaatgtgactgaggaaacacctgaaggtgaagaacatcatccagtggcagacactgaaaataaggagaatgaagttgaagaggtaaaagaggagggtccaaaagagatgactttggatgagtggaaggctattcaaaataaggaccgggcaaaagtagaatttaatatccgaaaaccaaatgaaggtgctgatgggcagtggaagaagggatttgttcttcataaatcaaagagtgaagaggctcatgctgaagattcggttatggaccatcatttccggaagccagcaaatgatataacgtctcagctggagatcaattttggagaccttggccgcccaggacgtggcggcaggggaggacgaggtggacgtgggcgtggtgggcgcccaaaccgtggcagcaggaccgacaagtcaagtgcttctgctcctgatgtggatgacccagaggcattcccagctctggcttaactggatgccataagacaaccctggttcctttgtgaacccttctgttcaaagcttttgcatgcttaaggattccaaacgactaagaaattaaaaaaaaaaagactgtcattcataccattcacacctaaagactgaattttatctgttttaaaaatgaacttctcccgctacacagaagtaacaaatatggtagtcagttttgtatttagaaatgtattggtagcagggatgttttcataattttcagagattatgcattcttcatgaatacttttgtattgctgcttgcaaatatgcatttccaaacttgaaatataggtgtgaacagtgtgtaccagtttaaagctttcacttcatttgtgttttttaattaaggatttagaagttcccccaattacaaactggttttaaatattggacatactggttttaatacctgctttgcatattcacacatggtcaactgggacatgttaaactttgatttgtcaaattttatgctgtgtggaatactaactatatgtattttaacttagttttaatattttcatttttggggaaaaatcttttttcacttctcatgatagctgttatatatatatgctaaatctttatatacagaaatatcagtacttgaacaaattcaaagcacatttggtttattaacccttgctccttgcatggctcattaggttcaaattataactgatttacattttcagctatatttactttttaaatgcttgagtttcccattttaaaatctaaactagacatcttaattggtgaaagttgtttaaactacttattgttggtaggcacatcgtgtcaagtgaagtagttttataggtatgggttttttctcccccttcaccagggtgggtggaataagttgatttggccaatgtgtaatatttaaactgttctgtaaaataagtgtctggccatttggtatgatttctgtgtgtgaaaggtcccaaaatcaaaatggtacatccataatcagccaccatttaacccttccttgttctaaaacaaaaaccaaagggcgctggttggtagggtgaggtgggggagtattttaatttttggaatttgggaagcagacagctttactttgtaaggttggaacagcagcactatacatgaaatataaaccaaaaacctttactgtttctaaatttcctagattgctattatttggttgtaagttgagtattccacagaaagtggtaattatctcttctctcttcctccattagaaaattaggtaaataatggattcctataatgggagcatcaccacttattaaaacacacatagaatgatgaattaaaaaagttttctaggattgtcttttattctgccacatttattgataaacagtgaaggaatttttaaaaaatttttaagaattgtttgtcacgtcatttttagaaatgttctacctgtatatggtaatgtccagttttaaaaatattggacatcttcaatcttaaacatttctatttagctgattggttctcacatatacttctaaaagaaacttttatgttataagagttactttttggataagatttattaatctcagttacctactattctgacattttaggaaggaggtaattgtttttaatgatggataaacttgtgctggtgttttggatcttatgatgctgagcatgttctgcactggtgctaatgtctaatataattttatatttacacacatacgtgctacccagagattaatttagtccatatgaactattgacccattgttcattgagacagcaacatacgcactcctaaatcagtgtgtttagacttttcaagtatctaactcatttccaaacatgtaccatgttttataaacctcttgatttccagcaacatactatagaaaacacctgctactcaaaacacaacttctcagtgtcatccattgctgtcgtgagagacaacatagcaatatctggtatgttgcaagctttcaagatagcctgaacttaaaaagttggtgcattagttgtatctgatggatataaatttgcctcctagttcactttgtgtcaagagctaaaactgtgaacctaactttctcttattggtgggtaataactgaaaataaagatttattttcatgctcacttcttaaaagtcat

SEQ ID NO: 180651 - DNA, 727 bp, Homo sapiens
  Payload ID: 15576
  Gene Symbol: SRRT
  Gene Name: serrate, RNA effector molecule
  ENST ID: ENST00000423692
  CDS Start-End: 1-232
cgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtgagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccgctagttaaatcttgagctctgtttgaccaagcggccaaggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcag

SEQ ID NO: 180652 - DNA, 446 bp, Homo sapiens
  Payload ID: 15576
  Gene Symbol: SRRT
  Gene Name: serrate, RNA effector molecule
  ENST ID: ENST00000445337
  CDS Start-End: 1-446
ggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccac

SEQ ID NO: 180653 - DNA, 448 bp, Homo sapiens
  Payload ID: 15576
  Gene Symbol: SRRT
  Gene Name: serrate, RNA effector molecule
  ENST ID: ENST00000449389
  CDS Start-End: 1-142
gcggccgctgcataagacctgctccctcttcatgcgcaacatcgcgcccaacatctcccgggccgagatcatctccctttgtaaaaggtacccaggctttatgcgggtggcgctctcagagccccagccagagaggaggtgagtaactcggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaag

SEQ ID NO: 180654 - DNA, 397 bp, Homo sapiens
  Payload ID: 15576
  Gene Symbol: SRRT
  Gene Name: serrate, RNA effector molecule
  ENST ID: ENST00000431645
  CDS Start-End: 62-397
gggcgggcgcggagaaactcggggcgagtggaggtgttggagccgcgttctcaggcctaggatggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtggg

SEQ ID NO: 180655 - DNA, 1607 bp, Homo sapiens
  Payload ID: 15576
  Gene Symbol: SRRT
  Gene Name: serrate, RNA effector molecule
  ENST ID: ENST00000448764
  CDS Start-End: 1-1500
gagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcactt

SEQ ID NO: 180656 - DNA, 2955 bp, Homo sapiens
  Payload ID: 15576
  Gene Symbol: SRRT
  Gene Name: serrate, RNA effector molecule
  Uniprot ID: Q9BXP5
  ENST ID: ENST00000618262
  CDS Start-End: 222-2840
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 180657 - DNA, 2905 bp, Homo sapiens
  Payload ID: 15576
  Gene Symbol: SRRT
  Gene Name: serrate, RNA effector molecule
  Uniprot ID: Q9BXP5
  ENST ID: ENST00000611405
  CDS Start-End: 160-2790
gttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 180658 - DNA, 2964 bp, Homo sapiens
  Payload ID: 15576
  Gene Symbol: SRRT
  Gene Name: serrate, RNA effector molecule
  Uniprot ID: Q9BXP5
  ENST ID: ENST00000614484
  CDS Start-End: 222-2849
gggtgacgcaggcgcagcgcgggctgcgcgcgctactgcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagatactccccccaggtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 180659 - DNA, 556 bp, Homo sapiens
  Payload ID: 15576
  Gene Symbol: SRRT
  Gene Name: serrate, RNA effector molecule
  ENST ID: ENST00000614370
  CDS Start-End: 185-337
gcccatccccggttgtcccacttttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagacagggtctccctctgtcacccgggctgagtgcactggtgcagtcgaagcttgctgcagccgcgacctgcccagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccct

SEQ ID NO: 180660 - DNA, 2893 bp, Homo sapiens
  Payload ID: 15576
  Gene Symbol: SRRT
  Gene Name: serrate, RNA effector molecule
  Uniprot ID: Q9BXP5
  ENST ID: ENST00000618411
  CDS Start-End: 163-2778
tttgttcgcctctcttcggccctctactcaagagctccgtctccgtctcgccctcctcgaagtcctcgtcgcgcgcccgcgacccaggtcgccctgaaatctagcccgtccgagcgcgagtccaacggccgcggccgcaccaaggccccctcagaccgtgccatgggtgacagtgatgacgagtacgatcgaaggcgcagggacaagttcagaagagagcgcagcgactacgaccgttcccgcgagagagatgaaagacgtcgaggggacgattggaatgacagagagtgggaccgtggccgtgagcgccgtagtcggggtgaatatcgggactatgaccggaatcggcgagagcgcttctcgccacctcgccacgaactcagcccgccacagaagcgcatgaggagagactgggatgagcacagctctgacccataccacagtggctatgagatgccctatgctggggggggtgggggcccaacttatggcccccctcagccctggggccaccctgacgtccacatcatgcagcaccatgtcctgcctatccaggccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtttcggtctaagtaccacccagatgaggtggggaagcgtcggcaggaggcccggggggccctgcaaaaccgactgagggtcttcctgtccctcatggagactggctggtttgataaccttctcctggacatagacaaagctgatgccattgtcaagatgctggatgcagccgtgattaagatggaaggaggcacggagaatgatcttcgcatcctggagcaggaggaggaggaggagcaggcaggaaagcctggggagcccagcaagaaagaagaaggacgggctggagcaggcctaggggacggggagcgcaaaaccaacgacaaggatgagaagaaggaagacggcaagcaggctgagaatgacagttctaatgatgacaaaacaaagaagtcggagggtgatggggacaaggaagagaagaaagaagactccgagaaggaagccaaaaagagtagcaagaagcggaaccggaagcacagtggtgacgacagctttgacgagggcagcgtgtcagagtctgagtcggagtcagagagcggccaggctgaggaggagaaggaggaggccgaagcgctcaaggagaaggagaagcccaaggaagaagaatgggagaagcccaaggacgccgcggggctggagtgcaagccgcggccgctgcataagacctgctccctcttcatgcgcaacatcgcgcccaacatctcccgggccgagatcatctccctttgtaaaaggtacccaggctttatgcgggtggcgctctcagagccccagccagagaggaggtttttccgtcgtggctgggtgaccttcgaccgcagtgttaacattaaagagatctgttggaacctgcagaacatccgtctccgggagtgtgagctgagccctggtgtgaacagggacctgacccggcgcgttcgcaacatcaacggcatcacccagcacaagcagattgtgcgcaacgacatcaagctggcggccaagctgatccacacgctggatgacaggacacagctttgggcctcagaaccagggacgcctcccctgcccacgagcctgccctcgcaaaacccgatcttgaagaatatcaccgactacctgatcgaggaagtaagcgccgaggaggaggagctgctggggagcagcgggggcgctcctcctgaggagcctcctaaggaagggaacccggcagagatcaacgtggagcgggatgagaagttgattaaggtcttggacaagctcctcctttacctgcgcatcgtgcattccttggattattacaacacctgtgagtaccccaacgaggacgagatgcccaatcgctgtgggatcatccacgttcgggggcccatgccacccaaccgcatcagtcacggggaagtgctggagtggcagaagacttttgaggagaagctcacgccgttgctgagtgtgcgggagtcactctcagaggaagaggcccagaagatggggcgcaaagacccagagcaggaagtggagaagttcgtcacctccaacacgcaggaactgggcaaggataagtggctgtgtcctctcagtggcaagaaattcaagggtcctgagtttgtgcgcaaacatatcttcaacaagcatgcagagaaaattgaggaagtgaaaaaggaagtcgcgttttttaacaacttcctcactgatgctaagcgcccagctctgcctgagatcaagccagcccagccacctggccccgcccagagtttgaccccaggactcccctacccacaccagactccccagggcctgatgccctatggtcagccccggcccccgatcttgggctatggagctggtgctgtccgccctgcagtccccacaggaggccctccatacccccatgccccgtatggtgctggtcgagggaactatgatgccttccgaggccagggaggttatcctgggaaacctcgcaacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacaggg

SEQ ID NO: 180661 - DNA, 2114 bp, Homo sapiens
  Payload ID: 15577
  Gene Symbol: SERTAD1
  Gene Name: SERTA domain containing 1
  Uniprot ID: Q9UHV2
  ENST ID: ENST00000357949
  CDS Start-End: 160-870
gtagttaggagtctggagtcgtgagccggagtcagaactgcgtctcgcgacccaggcgcgggtttccggaggacagccaacaagcgatgctgccgccgccgtttcctgattggttgtgggtggctacctcttcgttctgattggccgctagtgagcaagatgctgagcaagggtctgaagcggaaacgggaggaggaggaggagaaggaacctctggcagtcgactcctggtggctagatcctggccacacagcggtggcacaggcacccccggccgtggcctctagctccctctttgacctctcagtgctcaagctccaccacagcctgcagcagagtgagccggacctgcggcacctggtgctggtcgtgaacactctgcggcgcatccaggcgtccatggcacccgcggctgccctgccacctgtgcctagcccacctgcagcccccagtgtggctgacaacttactggcaagctcggacgctgccctttcagcctccatggccagcctcctggaggacctcagccacattgagggcctgagtcaggctccccaacccttggcagacgaggggccaccaggccgtagcatcgggggagcagcgcccagcctgggtgccttggacctgctgggcccagccactggctgtctactggacgatgggcttgagggcctgtttgaggatattgacacctctatgtatgacaatgaactttgggcaccagcctctgagggcctcaaaccaggccctgaggatgggccgggcaaggaggaagctccggagctggacgaggccgaattggactacctcatggatgtgctggtgggcacacaggcactggagcgaccgccggggccagggcgctgagccctcgtgctggaatggttgtctggtatctgaactgagcctgctggctggaccaactgtcctcgaaaagacacagctggcttccctagtacagagaacagggcttgggccactttggagagacagaatctagtcctgggcaacttcacatccgtcctcctgtctcagggctggcagggggagcctggaattaccccctagtgatggaatgacagggtctggtggggactgaattccctggccctggggtcatagcttgggctgttccttctctgatacgggaagagaccccaatcagatttttcaaattaaagccagtcctgggaaatctcaaatccgtgtgctgctttgtctctgggcaaatgtgaaggcgagataaaaacatcaaacattttattgggcgtaggctgtgtacgaggcacagtttctaagcacgtcactgtgttaactcatttaatcctataacagccctacaagatcggtagtattatcatccctattttacaggtgagaaaaccaaggttccaagattatcacttgaggtgggttttaaattatgaacttttttttttttttttttgagatagggtctcgctctgtcacccaggttgaagtacagtggtctgatcatggctcactacagcctcaaactcctgggctcaagcgatcctcctaccaggccactttttttttttctttcttttttttttaagacagattcttactctgtcgcccaggctggagtgcagtggcgtgacttcggctcactgcaacctccacctcccaggttcaaacgattctcctgcctcggcctcccaattagctgggaccgactaattttttatattttttgtagagacagggtttcaccgtgttagccaggatggtcttcatcttctgacctcgtgatctgcctgcctcagcctcccaaagtgctgggattacaggcgtgagccactgtgcctggcctttttttttttttcttaaattttatttcttttctttgctagcaggaagtcaaggcaactttttaaaaatgaaagcaagtcctcgcctggagtctacctgtatttattgaggagcgaaggggagattgctttcagaatggtcccgaaataaaaacacaaaacctggaccctggacagatcctctccaaggagccctgagagtcggctctccaggaaaatgggggaggaaagggggacaacagcccatttttaaaaataaaattcactcctggtctt

SEQ ID NO: 180662 - DNA, 5549 bp, Homo sapiens
  Payload ID: 15578
  Gene Symbol: SERTAD2
  Gene Name: SERTA domain containing 2
  Uniprot ID: Q14140
  ENST ID: ENST00000313349
  CDS Start-End: 299-1243
actcctgcacggcgagtgctggagcacgacgtaccgctcgctcggtcagggcgccccctccgcccgcctcctgcttcctcctccgctgcctgccgccgccgcctccaccattgtataatgctcggggcgcgcaggcagagaacggcggagtcttagcttcagcctcgcctgctgcccgctccccggcgccaccctcgggcccctggagcggggcactccgcatggagcgggagtagctgaggagtgggcggaaacccctcctgatgcgttagttcccaggtggagctgcatgtgatatatgttgggtaaaggaggaaaacggaagtttgatgagcatgaagatgggctggaaggcaaaatcgtgtctccctgtgacggtccatccaaggtgtcttacaccttacagcgccagactatcttcaacatttcccttatgaaactctataaccacaggcccctgacagagcccagcttgcaaaagaccgttttaattaacaacatgttgaggcggatccaggaggaactcaaacaggaaggcagcctgaggcccatgttcaccccctcctcccagcccaccaccgagcccagcgacagctaccgagaggccccgccggccttcagccacctggcgtccccgtcctcccacccctgcgacctcggaagcactacgcccctggaggcctgcctcaccccggcctcactgctcgaggacgacgatgacacgttttgcacctcccaggccatgcagcccacggctcccaccaaactgtcacctccagccctcttgccagaaaaggacagtttctcctctgccttggacgagatcgaggagctctgtcccacatctacctccacagaggcggccacggctgcgactgacagtgtgaaagggacctccagcgaggctggcacccagaaactcgacggtcctcaagagagccgcgcagatgactcaaaactgatggactctctgcctgggaattttgaaataacgacgtccacgggtttcctgacagacttgaccctggatgacatcctgtttgctgacattgatacgtccatgtatgattttgacccctgcacttcctcatcagggacagcctcaaaaatggcccctgtgtctgccgacgacctcctcaaaactctggctccttacagcagtcagcctgtcaccccaagtcagcctttcaaaatggacctcacagagctggaccacatcatggaggtgcttgttgggtcctaagacccagggacccagcgactatgcccacccagaccccagagcgttcccataaccctgacagttctccacactgtgcatgcacccttgcttgcctttttcagagaaaaagaaaattttacaacaggatcacactagtttttgctttgagcagagttggagtgccttcatccaagtatgaccacttttaatacacttttttgagtggttcctcagagacctactaccctggtataggaaagaatccatttgaagacaatgttgcaatgttgaatgacaaaaataaacagttcaagtgaagcacaaggattaagttggaaaagctgtaaattgcatgtgcatatttgtctattttttctataagttttattgcaagaggtaaagaagaaaactatatatatatatcttatttagataatctcagtaccttttctggcatttttgccctgtataggttgacttggcaattcggcctttttagaggcattaactactcctcgtaagtgttgcatttacatggctgtttagaaaactgctgcccaaatttattttatatttttgtacagattctgcagtttatgatattgtttttctaaaaacaaatgctgtttatacatatgagatagctattttgataggatttgctcacatagttcctgcaaacttcagatgtacaagttgcacttgtacttttatagagttgtaatgttttatatgtgtatggtgcaagagaaaattggatcaaatcaatctgcagttgatgtccccaaatgcaaacacaggcacacacatgcacacacccataaacacacacacagtgctttaagaaagggccaggtgatatcacacccaaatttcacaagcactgaccccctggcaccaacacccgccagtactgtgacttccaaagccagagccacatgtgctcatcaaacttgcattaagcagttggcgggagatggctgtggagctgggggtttaagtgatggttctcttttgctccctcttttgagggtaaagctactgtctttcttaagagtgtatttatgccaagtttgcgcttttaattgtttttattttgttttttaatgaaaacccagatctttcctttttggcataatttttatgatgacctgaaattttacatccgaacaaaattttacatccgaaaagcaaccaacttcttcatggaactcagccctgttgcaatgcttagggcccttaaagaagaaaatctccccagaaggcatccatcatgttgcttaattgtcttctgcagcttcctttccctagagctttccctgtgttgctaagagctgaaaatggcatcttcgtgatcaccacagtgagcttggctcgcctcggccggcccgggatgcactcttacaacatgtgtgactcttgaacctggagttcatcacattacgtcacagcttcccatctggttgctttcctgagtcagctacttcacacttgtcaaggctgttttaccccaaaactcagacaggactttctatgcatgttttccctcctccccccaattcccccccccatcaccttatctcccaggacacacttgagaagtagctttttattcctagtggtgtacatttaattttaaaaaggttgcaatgtatcatgcttgttgccgaaactgtttatggccttcttgtttcagttttttcttttcttccaatggtactttagctgttgagtgcaggttacaacctatattgttatgcagatggcttctttaggaataacttttatatttatttaaaaatttttaaattatgggatgttttgttgttgttgttgtctttgttgttggtcatttgtcaatattcagtcaccaattctgctcacttcttgccatggataaaattgggtctttctggctaattaaaaaagacaactttataaaatggcactttaagcaagccatagttagttttatttttgtaatgcacatggcaaagcaaagacgtttgtgatgaaggaactgctcatctaagcaaaagatttgagtatgatatgataaaggctttctacattctaatttactttttccccccacttgaatgtgttttaaaggctaattatcagctcagtagagcagtgagaaactgatcaaattgcacttgttctcctacaagcaacctccacgcagacacctcgtactgctacaggtgtgtcatttcctttaataggaccagggaccatgtaactgaggtgagggttgtagtagatgcttccagtgtcagtatgcctgttaattttaagagcttccctttcttgcagagaacaagtctgcccagattccatgctttctataactggaggacctggcaaacctgccgcatgctgcacacatctacctacgtacacatatacaatagtattgatgattctgaacaataacagggtaaaacagttggtttgccattgttaaaaactgatttacagtaacttacaacaactgtacttttgttggattagcaaatcatgtgtttaaacaaatcccatatgttgggcaacagttcaaataagcacggagaagtgttgcccaaacttggttctctgactcttatgtatttgtaaggctgggcttcaaaatcaaaacaaaaaccccaaaaacagcaggcaaatgctttttaactctgacaccgttgccataaatccctgatactcaaagtctaacaagaaagacatggaaaattagcagcccattttcagaaagatcaaaatgatctagggttctaattgcttttgcatcctattcttacaaagtgatgtcccaacagggaacagtaggagctggagtgggatctccaagtcccagtttgagtgtgggatgtgcttccagcagtgccttccctttatgaaagacatcacatggcatccagggccaggcaggcagcttgaggtgcctttacgagaaaaccgagctggggctgggagaggacagttattgacactgatgtgcaatgaagtgacaagatgagagcagaatcgtaagagctttgaatttgaagtgagtttttttccccccataagttatttattccttttttctgtgtaaatatatttattttactgtggagcgctaacatctggatcgtaacatgtgcagaatgtatggtaggaatgtattctcttgtaggaatgtaaatctgtattaaaagggggtccaagccaggcccccaggtcttctcattgtatgcacagtccgcattcatttttactcttctctaatatgggtctatttgaaatatgcaaaaggtatgaggaatgttttaatacctccaaatttttaagaaaagcatcaaagggttgatattttttaaagtttttttagtagcactttctctggatgacagaaggagcaaccacatgggcacccttgttcataccaaagggtgagcagtggccagagcctcctctgcacctctcgagtgtctttaccaattgagctttttatcgccatagccccttggagtgccccagctgccctgaggtcaatcaaggaaaatttcttaatgaaataagctccaaagagccaaagtatcaacttacagatcgtttttaaagcttaaatttatgaaccacctttgtggtaaacaatgaattatgaataccgcagggcagccttcttaaatgacaaatgtaaaaaaaaaaaaaaaaaagactctacttcgtgcagcaattgctactctatacgaattgtcttaatttgaaaaccttgctgttacaaattggacctttatacattttctgaaaacaatgaaaagagtatatttaaccttttctggctgtaaatggttaccttcctgtaactgccccgcacctggaggcatggagttgtgtgcatcctgcttatgtacaattgttttcagtgtttctaagaatgagtctgaatggttcttgaaaattagccaggatcaaatgctattgcagacaaagccaataaaaagttggacttcttttggggataacaagttttggaagagaaatgcaggccatatgtgcgcatgaccgagattttgaaaaaagatgtacatagtgacatgtttggtgcatggtttttgaggagggcttttgtcaaaaaggaggtataacctttcccccacagacctgagagctgtgccttttctatgcaatattacagacgttacatcggaacccagatggctgtattcacatgtaggtttgggctgtaatctaaacaattggacagattaaatgtacatggaaatgagcagtcttacttttgtagttttatattatacaataaacagttaaaagatga

SEQ ID NO: 180663 - DNA, 1734 bp, Homo sapiens
  Payload ID: 15579
  Gene Symbol: SERTAD3
  Gene Name: SERTA domain containing 3
  Uniprot ID: Q9UJW9
  ENST ID: ENST00000322354
  CDS Start-End: 498-1088
cggccccgcccgcctgcacagcgacttggggaggggcatgccagcccctctggctccacggtggagtccaggcctaccataaaggaaccgcagggagcaatggtgacgatcttggagcgaggactgtagctgagtggaaggaagcggttctgttggaccggccgccctccaccccggagtcgctgccccgccccctgccagttgcacttctttaaatggcccggggcgctagggaggggtgggcggatccggcgtctcggggcacgggcggatggctccgcccagccaatcgacgccccgcggcgggcgggactccagccaatcgcggctcgcggctcggctccggggcggggctggtgggccagaggccagacggagaggccccgccgaggtgagcgaggctccaaccggtcactggtgggtcctggcactggcgggtcgcaacgctgtgggcgttccaggaggtggtcgtggcgaacctggcagctgcgggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 180664 - DNA, 1515 bp, Homo sapiens
  Payload ID: 15579
  Gene Symbol: SERTAD3
  Gene Name: SERTA domain containing 3
  Uniprot ID: Q9UJW9
  ENST ID: ENST00000392028
  CDS Start-End: 279-869
aggaaactgaggccctgagaattgactcattcagatcacttcccatgatcacgcagctgagcagtttccaatacagaattcagatttggggttccctacttccaatccaggtctctgtgctccacacttgtctttcgtgctccatgtttgaagaaattaatattgtggaagaacagttttaaggcttagaggaacttgagttaggatccgtacttggcagatgaggaaattgattctcatggatgtaaattcactgtttgaggccacaacagggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgccccaggttcttgggagtggaatgaactggatcacatcatggaaatcattctggggtcctaaaactgtgatagaggggatcgatccttcctcatgtcatcttcggtggcctggatccctgaatgcaactctgggtgtgtgtttttgtgggggctcgaagcagtgactatggcctcctttgttcccatttcagggttccacaaactgtcttgcatgtgtgtgtgtgtctggttaccccgaccttctgtgaaggtgggtcttcctgaattaatttatctattccaaatgccttaacgagactctgtttctgggagtctgattttccacttacacatttcttccacctttcctgctagttcccactcccctgtgaccactggggcctcagggaagataaagaaagctgggcctgtcgaaggatgacagggatgtgctgccaggttgctatagaaacccaggctctgcctcttgcaccttgagggggtgggaggggctggtgtcctccctccaggctgaaccccacttcctcggcaggaccccagtctcagcagcctcctgatttcataaccaggccggaccacgtgcaatagggtggaaaccaaactgctccatgccgggttatttaaaagaaaggcagagtttgtggtggcttttttttttttttttggattgtttgtaatttttttaaataaaagtattttggaaggag

SEQ ID NO: 180665 - DNA, 747 bp, Homo sapiens
  Payload ID: 15579
  Gene Symbol: SERTAD3
  Gene Name: SERTA domain containing 3
  ENST ID: ENST00000599706
  CDS Start-End: 215-747
gagttcaagacccaggaggggaggcgaggttgttggggcagtattttcaagtggagggagtttgaagctgggacgttgggcttttggagaagcgagagaacagaggggaggaacttttgagacagggaacctggagattcgattccacttgggtcttccggacgggttgaattcggggctttatcgtgttctggaaaaggtgtgagagggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtcagccaccattggctctatcctcagggagctggacacctccatggatgggactgagccccctcagaatccagtgactccccttggcctccagaatgaagtgccaccccagcctgatccagtcttcttagaagctctgagctcccggtacttgggggactctggcctggatgacttctttctggacattgacacatctgcggtagaaaaggagcctgcacgggccccaccagagcctcctcacaacctcttctgtgcccc

SEQ ID NO: 180666 - DNA, 535 bp, Homo sapiens
  Payload ID: 15579
  Gene Symbol: SERTAD3
  Gene Name: SERTA domain containing 3
  ENST ID: ENST00000596456
  CDS Start-End: 261-535
ctggcgggtcgcaacgctgtgggcgttccaggaggtggtcgtggcgaacctggcagctgcgatttggggttccctacttccaatccaggtctctgtgctccacacttgtctttcgtgctccatgtttgaagaaattaatattgtggaagaacagttttaaggcttagaggaacttgagttaggatccgtacttggcagatgaggaaattgattctcatggatgtaaattcactgtttgaggccacaacaggcaaggcatcatggtgggaggcttgaagaggaaacactctgatttggaagaggaggaggagaggtgggagtggagtccagcaggccttcagagctaccagcaagccctgctccgcatctccctagacaaagtccagcgcagcctgggcccccgagcacccagcctccgcaggcatgtcctcatccataacaccctccaacagctgcaggctgcacttcgcctggctcccgcccctgccctgccccccgagcccctcttcctgggcgaggaggatttctccctgtc

SEQ ID NO: 180667 - DNA, 5219 bp, Homo sapiens
  Payload ID: 15580
  Gene Symbol: SERTAD4
  Gene Name: SERTA domain containing 4
  Uniprot ID: Q9NUC0
  ENST ID: ENST00000367012
  CDS Start-End: 231-1301
accataaccgtctgcagcgacggcggcgcagcgccccagtcgcggcggcgggacctgccgggacccttgcccgccgcgcacccgcagtcaccgccgagcgggcggccgggccgggacccgcgagtgtgcaccggcggccgggctggcgccgagcccagagcggaccagcagcagctcaagcgctgcggccgccgcctccccgctgaccccgcgatctgaggctgtcagagatgactctggttctgtccatgaatagattctgcgagcccattgtctcggaaggagctgctgaaattgctgggtaccaaacactatgggaggctgacagctacggaggcccaagccccccagggccagcacaagctcctttgcagggagaccggggagctggtcccccactggcaggatcacattacaggggaatttcaaatcctataacaacatccaagatcacatactttaagaggaagtatgtggaagaagaggattttcacccaccactcagcagctgtagccataaaaccatctcaatttttgaggaacgagcccacatcctttatatgtccttagaaaagctaaagtttatcgatgatcctgaagtgtacctccgaagatctgtccttataaacaatttgatgaaaaggatccatggagaaattatcatgcagaataactggtgcttccctgcctgctctttcaatggcacctctgcccaagagtggtttatggctcaagactgcccttaccgaaaacgaccacggatggccaaagaggaatgtgaaaagtttcatgcctgctgcttttaccaagaatgtggtggccactacctaaatttacccctttctgtcaatgctaatgttggaagtgcctccactgctgcctcctctccctccgcctcttcttcctcctcatcttcctcttcctctccccctttgcctttaccgagttgttcccgccaggtggattttgatgtaggtagtgcatctatttacaagagtgatggccagatacctgccaatgaaatctttgtcactaatgtcagatcacttggtgttcaggaaaaggccaaattaaatgatgagaaagcaaatgatgacaccaacagagatggtggccccctcagccacgaacctgtgggaaatgaccttgcttttgagtgcaaaggccaattttatgattattttgagaccggatataatgaaagaaacaatgtaaatgaatcttggaaaaagtccttacggaaaaaggaggcttcaccaccaagtaacaaactgtgctgcagcaaaggaagtaaaatatgagccatcttctcaccgaactttgaagcatgcacagcatgatcagttagctctcgtaaattttattttgaatggattttgtagttttgtacaacagataaaattatgccatgaacatgccatgtcgttttaatgcctggagagcagattgcgtaaaacatctgtatagcaggcatcagcgagcttcttataaatgtggtgatttttaccaaggaaacgattgacttaatgcttaaaagtatatcatagttttcttacggaaaagatcagtagatgagattgggggacaatgtgcccttgcaatatttccattgccccccaaggagcctgtcactagctaagaaatttctacatgtttgccagttaattagggagttatttggtaagcaaatcaatataaccagcaaagatacctgcttcttctatatgatacaatattttttttaaataaaagactaaagacagggagctagatgaaatggcttaatggtgctgttaagtatttgtacctaacagtcttgtgtgacagatgaaaataggatgtaacataatgaaacacacctgtctaggggcggcaatcaacagtcttacacagagagggtattccctgcaagtttctggcttgcctgtgatgggtgatgaggcttttagagaggtgttatacagggcgatttttggtgccttacttttatcttaatttttgccaatgtgaaaattaaggataaatcagagttacagcagggatttaacaaacaggacaaaaaaaaaaaaaaaaaaaaaaccacagggtggatcaatatggtttggaaactgttaactttgaactattgtgttcagcttttgattcgacatctctattctttatttttgatgcccaattgcttttggattcgccgttttttcaatagggatggaggaaatgagagagagagctgttagaaagcagcacgggctgctcgagcttttctatggcaactgtgtgttgctggggttggggttttctgggttttgggttgttttgttttgttttcttgtccaatgaagttcacgaaccagtggcatgcattatacttttctctgttttgcatcatttcacttgtttagattataaaagcatgtgggtttttatatatgaactttgctgttgattaagaagcacaatgttaataaatgatgtggtgatcaataaggtttatcttaaagaatgtaaagactttaggtttttgaaagttattttggagaaatgggacttaatctataatagttactatgtatttggtctacattttccaaataatatctttaacttgtacatttgaaaagtgttcagagtggccctcctaccatccttccttccactccagccaactcttcctgctaaactgtattccagtttccaagtttactaattgacttgggcctgttcaaataatacttcacagaaaccaaatgccaaacggaggaaataagtaagccctcccagtttctccaagataaagctttttttattattgctattaatattaaatataggtctcattcatacagtgtatgagtaggatcatttggacaattgtccacaaagaccaatttttaaaacattttcttgtgttatagttaaatagtctagtaatgttttgtcctttattttcaatatttgataaacatttgatgttcaaaacttagctaatagatgcttgtatatgaatgtgttgtaataaagtgaggttttcttgatatatatttattaagatgataaaaattcattaagttttttaaattttaatggctattggctatgtttctcttttccattattctctctcctttaaaaaactcaaaacatctagaaactgtagtggatagtggccacacaggagttttctaaattaaagagtattttaaaatgccaatctgacaggtgtttcagaatgatcctagttcgtaagtttaagtttctattgattaagaagcacaatgttaatagatgatgtggtgatcaataaggttatgtctgaaagaatgtaaagattttcctttctggagtgtctctgaaaaaaattgtataacacgaagccataaatactgaatcttagctgattgcattatgaactgtcaaactgtgaagatgacccatatgtaaacagttataacagctacagattattgctagtagcattccatacaattccatattaatgttcttaggagctaatatttgataaaggggaaagctagttaaaaactaattaatttgtcaaatgtagcattcttattatgagtgtaatatctcatggagatttaaatatgaacgaaaggacttatccttctgctttttaaaagccccagcattactagatagtgtttttcttgaaggccaaagctgtaaaatgacaaagttggtgattttcagcagcactcacctgagctgtgagcgcctgcacctgttcggtagaacccactagaatcacttctctgtaggataagtgatgcctttgaatccagcagcataaaaatctgttctttttagtcatcaagtttttgtttccaggatatttctagcattgcaaaaaaaaatttcttcaccaaacactaattcctaaacacccatccaaaccacaaaaattctcttgttagtaggcgagagtgctaggacttcctgtgttcacctcccatgcacccagcattgtcttttatgcatgagatattccattagattttcctagagtggccaggacacccttcatagtaagttatatctcttaactggattctatagttttatctcgagcaacttggaaaagctaagacatcctccacccacactggtatctacgcgcctggaagctgcaccttctctcattgctgtgctctgctttaaggaaaacctgatatgacagaatcaagactattaaaagataaatgaggggaaatcttcatttaagaaagttgccttgctccccaagagtgcctttaattgctattcccctaggcatctgggtgcatatcattaatgaaatcattaacctttgtctctggtccttcctttctaaaaacagcagattatagaaggtggtctggcaaagggattttcaaagggcaaaagtctcatcatcatctttccactcaaaatcctattattctacatttcactttgcaggggtcctagggacaggattgcagggacaggggacatgggaggaagacagaaaaattcaaaaccagcagatgccactacctggcaatgaattgaaaattaggggaaagcatctttggcgtgaccttttattaagacaacagaaatttagaacattttacatgcttctttgttaaatggtgaagcaagggaatgaaagtatttatttttagagctcatagttaactccatcaagacatggctacccacccctccagttatgaacttgtattacagctccacttggtgacttcctttctgtgtatcaggagcagagcagaggacaacttgtagaagacatgaccattaagagacatcaacttcgcaacaaatataagacaaggatacaaggattcctatgtgatgcagctaggtttttatatccttctaacaaatggtgagcaggagacttttttggaaataattagttgtgaaattccatttttctgacagccccttaaatttgaagttatttcatttgtagttaaggttatcacatccctgccaattttactagattttttcagagacaagcattcagcatggcattagtaatgatggtttaaactaggtgcagaactgtcccatgaagagaagaatgatatcagtatttaaataataaaagaagagacaatgtatggtttatagtgattcattttaagattgctgtattttgattttgtggtttaaaataaatgcattaaggatcttttaagttactacaa

SEQ ID NO: 180668 - DNA, 5219 bp, Homo sapiens; identical to SEQ ID NO: 180667
  Payload ID: 15580
  Gene Symbol: SERTAD4
  Gene Name: SERTA domain containing 4
  Uniprot ID: Q9NUC0
  ENST ID: ENST00000630425
  CDS Start-End: 231-1301

SEQ ID NO: 180669 - DNA, 615 bp, Homo sapiens
  Payload ID: 15581
  Gene Symbol: SAA1
  Gene Name: serum amyloid A1
  Uniprot ID: P0DJI8
  ENST ID: ENST00000356524
  CDS Start-End: 128-496
tccccagggaccacatccagcttttcttcgctcccaagaaaccagcagggaaggctcagtataaatagcagccaccgctccctggcaggcagggacccgcagctcagctacagcacagatcagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtgg

SEQ ID NO: 180670 - DNA, 675 bp, Homo sapiens
  Payload ID: 15581
  Gene Symbol: SAA1
  Gene Name: serum amyloid A1
  Uniprot ID: P0DJI8
  ENST ID: ENST00000405158
  CDS Start-End: 185-553
agggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaatttgtggaaa

SEQ ID NO: 180671 - DNA, 583 bp, Homo sapiens
  Payload ID: 15581
  Gene Symbol: SAA1
  Gene Name: serum amyloid A1
  ENST ID: ENST00000532858
  CDS Start-End: 103-471
aggcagggacccgcagctcagctacagcacagatcagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaccgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaa

SEQ ID NO: 180672 - DNA, 563 bp, Homo sapiens
  Payload ID: 15582
  Gene Symbol: SAA2
  Gene Name: serum amyloid A2
  Uniprot ID: P0DJI9
  ENST ID: ENST00000256733
  CDS Start-End: 46-414
tggcagacagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatttgttgaaaca

SEQ ID NO: 180673 - DNA, 1022 bp, Homo sapiens
  Payload ID: 15582
  Gene Symbol: SAA2
  Gene Name: serum amyloid A2
  Uniprot ID: P0DJI9
  ENST ID: ENST00000414546
  CDS Start-End: 46-297
tggcagacagggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagtttattttcagctgaactgtagagagtgaaggaagaagccttttttcttcactcctacatgacccaggcattgatccaggcaatgaagattcagtgtaaataaccaccactaacaagaccatggcctttggaacctgtgctaagaggcatggatgagctccctcagcatgtggatggagactgaagagaggtctgaaggctcagtgtggtgtctccattctctaagaagtttggaggagaagctggatacagcaaaacagactgagaaggagcagctgttgggaaaggaggaaaactaggaaagcatggtgttccagaatccctgatggagatattgattagtagtatcagattctgcttagcagttgaggagttcacctttggcttaagcaacatggagtcattgactatctcgtgaaggtggttgcaggagaaggtctggagaactaaatggagcagtgataagagagaatgggagatggtatgataggactcctggacaccccagacatcaatcaaaacaccacagacaagaaggtgtggatacaaaaactagcagttagaagaaataatagaaaatgaactccaactacttctgaaaaaaaagtaatgagggcaattaatacattgaagaaagcctcaataagtacaacagtgtagtactgacttatatatagaaaaaacctgatcagtggaaccaaatcctcagaattagacataagtgcatatgagaattttgtatgtgat

SEQ ID NO: 180674 - DNA, 323 bp, Homo sapiens
  Payload ID: 15582
  Gene Symbol: SAA2
  Gene Name: serum amyloid A2
  ENST ID: ENST00000530400
  CDS Start-End: 9-251
tcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagagaagatgactgaggaatacaaccacaactggatggactttttcaaaagatgacacctgcttatttgcctcattcaaatttcaag

SEQ ID NO: 180675 - DNA, 948 bp, Homo sapiens
  Payload ID: 15582
  Gene Symbol: SAA2
  Gene Name: serum amyloid A2
  ENST ID: ENST00000528349
  CDS Start-End: 38-379
agggacccgcagctcagctacagcacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcaggctgaagtgccatggcatgatcatggctcactgcaacctcgacctcccggggctcaagagatcctcccacttcagcctcttgaataactgggactgcagatgtgcgccatgacacttgcctaatttttatattttttgtagagatggggtttcgccgtgtcacccaggctggtcttgaactcctgggctcaagtgatctgcctgcctcagcctcccaaagtgctgggattacaggcatgagtcactgagcccagcctactgttatatttatttttgtgtcggtttgaggctgcccagattcacattgtttctggggtcgtctgtgagggtgtttccagaggagattaacatttgaattggacttaataaagtagattgctattctcaatgcaactgggcatcacccaatctgttgaaggcttgaatagaacaaaaatagaggaaggacagatttgcctcccttttcccctgcctcactgcttgagttggacatctcctctcatcttctcttgccctcaaattggatttacgtgatcagttgctctggttctcaggcctttgaactcagactgaattacactttcctgagtttctagcttgcagagggcagatcgtgggacttctcagccccaattatcttgtgagccaattccttacaataaataaatacatacatacata

SEQ ID NO: 180676 - DNA, 687 bp, Homo sapiens
  Payload ID: 15582
  Gene Symbol: SAA2
  Gene Name: serum amyloid A2
  Uniprot ID: P0DJI9
  ENST ID: ENST00000526900
  CDS Start-End: 185-553
agggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtg

SEQ ID NO: 180677 - DNA, 610 bp, Homo sapiens
  Payload ID: 15582
  Gene Symbol: SAA2
  Gene Name: serum amyloid A2
  Uniprot ID: P0DJI9
  ENST ID: ENST00000529528
  CDS Start-End: 103-471
agacagggacccgcagctcagctacagcacagatcagttatcctggggcatacagccataccattctgaaggtgtcttatctcctctgatctagagagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcaatgccagagagaatatccagagactcacaggccgtggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatataataggcatctaataaatgcttaagaggtggaatt

SEQ ID NO: 180678 - DNA, 727 bp, Homo sapiens
  Payload ID: 15583
  Gene Symbol: SAA4
  Gene Name: serum amyloid A4, constitutive
  Uniprot ID: P35542
  ENST ID: ENST00000278222
  CDS Start-End: 182-574
aatttttaaaatacccaaagaattgagcaaaaaggactttggcaaggcaggttgttggatttaaaaccgttctcccattaatgccaaagccagcagaggtaccaactatagctccacggccagaagataccagcagctctgcctttactgaaatttcatctggagaaaggtccacagcacaatgaggcttttcacaggcattgttttctgctccttggtcatgggagtcaccagtgaaagctggcgttcgtttttcaaggaggctctccaaggggttggggacatgggcagagcctattgggacataatgatatccaatcaccaaaattcaaacagatatctctatgctcggggaaactatgatgctgcccaaagaggacctgggggtgtctgggctgctaaactcatcagccgttccagggtctatcttcagggattaatagactgctatttatttggaaacagcagcactgtattggaggactcgaagtccaacgagaaagctgaggaatggggccggagtggcaaagaccccgaccgcttcagacctgacggcctgcctaagaaatactgagcttcctgctcctctgctctcagggaaactgggctgtgagccacacacttctccccccagacagggacacagggtcactgagctttgtgtccccaggaactggtatagggcacctagaggtgttcaataaatgtttgtcaaattgaatttgtt

SEQ ID NO: 180679 - DNA, 1518 bp, Homo sapiens
  Payload ID: 15584
  Gene Symbol: SAAL1
  Gene Name: serum amyloid A-like 1
  ENST ID: ENST00000300013
  CDS Start-End: 42-1463
agcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgac

SEQ ID NO: 180680 - DNA, 1526 bp, Homo sapiens
  Payload ID: 15584
  Gene Symbol: SAAL1
  Gene Name: serum amyloid A-like 1
  ENST ID: ENST00000531581
  CDS Start-End: 47-1108
tccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaaggcaaatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactga

SEQ ID NO: 180681 - DNA, 657 bp, Homo sapiens
  Payload ID: 15584
  Gene Symbol: SAAL1
  Gene Name: serum amyloid A-like 1
  ENST ID: ENST00000530180
  CDS Start-End: 29-657
gccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggtgttattgcactgtttgtatgattcagacccacctactctgctggaaacaagcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatg

SEQ ID NO: 180682 - DNA, 604 bp, Homo sapiens
  Payload ID: 15584
  Gene Symbol: SAAL1
  Gene Name: serum amyloid A-like 1
  ENST ID: ENST00000530436
  CDS Start-End: 1-450
ctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactga

SEQ ID NO: 180683 - DNA, 1503 bp, Homo sapiens
  Payload ID: 15584
  Gene Symbol: SAAL1
  Gene Name: serum amyloid A-like 1
  ENST ID: ENST00000529318
  CDS Start-End: 47-1477
tccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaaggcaagtacaatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtac

SEQ ID NO: 180684 - DNA, 1582 bp, Homo sapiens
  Payload ID: 15584
  Gene Symbol: SAAL1
  Gene Name: serum amyloid A-like 1
  Uniprot ID: Q96ER3
  ENST ID: ENST00000524803
  CDS Start-End: 51-1475
ctcctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagtatgggatatgtcaatggatgaggacgtggctttatttctccaagaatttaatgctcctgatatattcatgggagtactggccaagtccaagtgtcctcgattaagagaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaagtagatcttcctctaattgacagcctcattcgggtcttacaaaatatggaacagtgtcagaaaaaaccagagaactcggcagagtctaacacagaggaaactaaaaggactgatttaacccaagatgatttccacttgaaaatcttaaaggatattttatgtgaatttctttctaatatttttcaggcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactgacagttgaaattgacttattggaaatattaactaaagcccatattagaccataa

SEQ ID NO: 180685 - DNA, 451 bp, Homo sapiens
  Payload ID: 15584
  Gene Symbol: SAAL1
  Gene Name: serum amyloid A-like 1
  ENST ID: ENST00000532452
  CDS Start-End: 1-401
cgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaatggagaatgaaatttgcagagcattaacaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctca

SEQ ID NO: 180686 - DNA, 949 bp, Homo sapiens
  Payload ID: 15584
  Gene Symbol: SAAL1
  Gene Name: serum amyloid A-like 1
  ENST ID: ENST00000531751
  CDS Start-End: 1-795
gaaatctgtgtgggaattttaggtaatatggcctgtttccaggagatatgtgtgtccatcagcagtgataaaaatcttgggcaggtgttattgcactgtttgtatgattcagacccacctactctgctggaaacaagcaggttgttgcttacttgcctttcccaggcagaagtggccagtgtttgggttgaaaggatccaggaacatccagctatttatgatagcatttgcttcattatgtcaagttcaacaaatgttgacttgctggtgaaggtgggggaggttgtggacaagctctttgatttggatgagaaactaatgttagaatgggtcagaaatggggctgctcagcctctggaccaaccccaggaagagtctgaagagcagccagtgtttcggcttgtgccctgtatacttgaagctgccaaacaagtacgttctgaaaatccagaatggcttgatgtttacatgcacattttacaactgcttactacagtggatgatggaattcaagcaattgtacattgtcctgacactggaaaagacatttggaatttactttttgacctggtctgccatgaattctgccagtctgatgatccacccatcattcttcaagaacagaaaacagtgctagcctctgttttttcagtgttgtctgccatctatgcctcacagactgagcaagagtatctaaagatagaaaaaggagacggtggctcagggagtaaaggaaggccagttgagcaaacagaagtgttcctctgcatttcaaaaccttcttcctttctatagccctgtggtggaagattttattaaaatcctacgtgaagttgataaggcgcttgctgatgacttggaaaaaaacttcccaagtttgaaggttcagacttaaaacctgaattggaattacttctgtacaagaaataaactttatttttctcactga

SEQ ID NO: 180687 - DNA, 3229 bp, Homo sapiens
  Payload ID: 15585
  Gene Symbol: SDPR
  Gene Name: serum deprivation response
  Uniprot ID: O95810
  ENST ID: ENST00000304141
  CDS Start-End: 331-1608
ggggaacaggaaagaaaagctaaacctgcaacaaagtgtcctgtgcccagaacgcggttaggaagtgtgtgcatacgtctgaaccctaaatggttctcagttctgtaaacttctcctcccactgggtggagtagggcctttaagagcagctggaatgcagttcccctgatcagcgtagccagttgttgcctgtctgaacctctgccagtcctggagactggtgccctgagctccaaccagcgggcctcatcctacaccctcaccaccgcaacttctcacccgagcaagaagcagctcccagagagaaagaacgttcccacctgcctagccatgggagaggacgctgcacaggccgaaaagttccagcaccctgggtctgacatgcggcaggaaaagccctcgagccccagcccgatgccttcctccacaccaagccccagcctgaacctagggaacacagaggaggccatccgggacaactcacaggtgaacgcagtcacggtgctcacgctcctggacaagctggtgaacatgctagacgctgtgcaggagaaccagcacaagatggagcagcgacagatcagtttggagggctccgtgaagggcatccagaatgacctcaccaagctctccaagtaccaggcctccaccagcaacacggtgagcaagctgctggagaagtcccgcaaggtcagcgcccacacgcgcgcggtcaaagagcgcatggataggcagtgcgcacaggtgaagcggctggagaacaaccacgcccagctcctccgacgcaaccatttcaaagtgctcatcttccaggaggaaaatgagatccctgccagcgtgtttgtgaaacagcccgtttccggtgccgtggaagggaaggaggagcttccggatgaaaacaaatccctggaggaaaccctgcacaccgtggacctctcctcagatgatgatttgccccacgatgaggaggccctggaagacagtgccgaggaaaaggtggaagaaagtagggcagagaaaataaaaagatccagcctgaagaaagtggatagcctcaagaaagcattttctcgccagaacatcgagaaaaagatgaacaagctggggacaaagatcgtatctgtagagaggagagagaagattaagaaatctctcacgtcaaatcaccagaaaatatcctcaggaaaaagctcccccttcaaggtttctcccctcactttcgggcggaagaaagtccgagagggagaaagccatgcagaaaatgagaccaagtcagaagacctgcctagcagtgagcagatgccaaatgaccaggaagaggagtcctttgcagagggtcattccgaagcgtccctcgccagcgctctggtggaaggggaaattgcagaggaggctgctgagaaggcgacctccagggggagtaactcggggatggacagcaacatcgacttgactattgtggaagatgaagaggaggagtcagtggccctggaacaggcacagaaggtacgctatgagggtagctacgcgctaacatccgaggaggcggagcgctccgatggggaccccgtgcagcccgccgtgctccaggtgcaccagacctcctgagcttagagccaccgtgccatcctgtgctgtgctcaagcgggcagccagggctgaagaacaaactcttgcacatctccagcacgactcacccactcctgcgttcctgtccaggcagtaatcattgaccatatagtcatagtaagacacacgagaccaggctttaccatgaaagcgacctgtcacggactccacttttaatttgctcttaggttctatctctgtagaatgtctccaagattgaagaagaaactgagcagttgaaaaatgctaatctctttgacttagtcagaaaaaaacagaggataattaagatactagtcatgaaaagtgattcattcttttttgtcattccataagcttgctgaatagtgtaccggtaatatattgtatttccaccgtactctgtgaatctaattattattctttaagtgttgatatataatatacataaatatgtaagctaaacatataactatatgttttaagaagaaaacatctacgaaaggtaaaaagagatgatcagttggttgtttacttgctagaaaccattgttttattgcaaacgaaggaaaaatgaagagattataaaagtcagctaatgaagtaagatacgtagtaaagtcaggactattcaaaaagtaagaaagaaaatttggaaaatgagagaaacaggaaacaaagaatgccgaaaagaatgaaaacagagaaaaaatgtatgtgcttgaaagtaaaatacttacaatagtagcttaactatttcactctttaaataaaaatactaaagaagttcgtatatcctggaataacatgtcatcttcaaaatatttttattttctaatatttttaataataaacattttatagtgttaaagctgtatttttcttaataaataaaggacattacaaatatttctttaaggaagttcaaaaggatgttgtcttgttaacactggaacgaatataaatcttcaaaatacaattaatatatactgttttgtggaaacttagctcatactattctttaatgctcttcaaatttaaactaacccttacattccatgtgatgtgatgtaggcttataagatgctaaaatctataggttttggaagtgaaagattctattttttctttttttgtacataatgggaatttcattccagattatattttatttacatattaatttcacagaatattaatatttcttaacttcttaaagcatgctagcgttttatgtatatgtacacatatattcagacagggtaattttatctgctgcctaacattgtactaaaatattgctttatctgtttttaattacaaaatgctaatgatttcttaaattatagtttaaagacaattggcccaggaagcaaatcccctgcctttagtatgaaccactataagtaaccttacaaatagagttaatccaagacaatattaacaaactgtgctttgtctttaataaaagggataggattaacaaacatattgatggcataacctattcagctatgtccttatttttgcaataatgtaacctcaaatattggattgttgaaccaacaatggctgtgttaaagaagattaaataaaccgaaaaataaaaagcatgaaacaa

SEQ ID NO: 180688 - DNA, 4202 bp, Homo sapiens
  Payload ID: 15586
  Gene Symbol: SRF
  Gene Name: serum response factor
  Uniprot ID: P11831
  ENST ID: ENST00000265354
  CDS Start-End: 359-1885
ggtcgggggatccctccgccgccagcgcgtggtcccggccccctccacccgccgtctcggccgcggccagcagcccctgccccccgggggacgctgacggccgcccggcgcgccgccctagcagacggacagggggcgctgcgcgcggcctggggcaacccgggccacaggggcaggaaagtgagggcccaggtcggcccgggcgtgcaggggccccgggttcgcagcggcggccgcggcagcgatagcggcactagcagcagcgggagtgccgggttgagccgggaagccgatggcggcggctgcggcggctccgattcctcgctgactgcccgtccgccctcctgcatcgagcgccatgttaccgacccaagctggggccgcggcggctctgggccggggctcggccctggggggcagcctgaaccggaccccgacggggcggccgggcggcggcggcgggacacgcggggctaacgggggccgggtccccgggaatggcgcggggctcgggcccggccgcctggagcgggaggctgcggcagcggcggcaaccaccccggcgcccaccgcgggggccctctacagcggcagcgagggcgactcggagtcgggcgaggaggaggagctgggcgccgagcggcgcggcctgaagcggagcctgagcgagatggagatcggtatggtggtcggtgggcccgaggcgtcggcagcggccaccgggggctacgggccggtgagcggcgcggtgagcggggccaagccgggtaagaagacccggggccgcgtgaagatcaagatggagttcatcgacaacaagctgcggcgctacacgaccttcagcaagaggaagacgggcatcatgaagaaggcctatgagctgtccacgctgacagggacacaggtgctgttgctggtggccagtgagacaggccatgtgtatacctttgccacccgaaaactgcagcccatgatcaccagtgagaccggcaaggcactgattcagacctgcctcaactcgccagactctccaccccgttcagaccccacaacagaccagagaatgagtgccactggctttgaagagacagatctcacctaccaggtgtcggagtctgacagcagtggggagaccaaggacacactgaagccggcgttcacagtcaccaacctgccgggtacaacctccaccatccaaacagcacctagcacctctaccaccatgcaagtcagcagcggcccctcctttcccatcaccaactacctggcaccagtgtctgctagtgtcagccccagtgctgtcagcagtgccaatgggactgtgctgaagagtacaggcagcggccctgtctcctctgggggccttatgcagctgcctaccagcttcaccctcatgcctggtggggcagtggcccagcaggtcccagtgcaggccattcaagtgcaccaggccccacagcaagcgtctccctcccgtgacagcagcacagacctcacgcagacctcctccagcgggacagtgacgctgcccgccaccatcatgacgtcatccgtgcccacaactgtgggtggccacatgatgtaccctagcccgcatgcggtgatgtatgcccccacctcgggcctgggtgatggcagcctcaccgtgctgaatgccttctcccaggcaccatccaccatgcaggtgtcacacagccaggtccaggagccaggtggcgtcccccaggtgttcctgacagcatcatctgggacagtgcagatccctgtttcagcagttcagctccaccagatggctgtgatagggcagcaggccgggagcagcagcaacctcaccgagctacaggtggtgaacctggacaccgcccacagcaccaagagtgaatgatccgcccgccgccctggacagatggcccaagggatggcaccacttatttattgttgccttttcacgttttctttacacacacgttgacgggccgcaggagggaggcggggaggaggaacgggcagccacaggactgagccctctcactccagccaaagaaatgggcctgcctgcctccacccgtcctccctcagcctccccttcttcccgccccacctcccatttctgttgctggaggggctgtcctccttcctgggaccccctcgccagcttggctcgatgtttgccatgagtattagcttacccaatgggaccgtgccccacctccccacacacaggccttctgtggggctgggcaccgtgtcctcctctgaggaagcagttggggccctcttgccagcctccttgctgaccccaggtcagccctgtgtctgtcacaggctgggtcaaaagagccctggctctgcccctcagggggccagctggggagatgggggcttcttcctcacactgctgtcctctcccccttcagctcctgagtagctgggcctgtgcactgggcaggttcctggggccgcctgccctgccttgccgctccccttggacctccaggggctcctgggttggagggaaccaccagcgttcccttctcccccttgtcttcccccctctcctcccagctgctttacttaaagttgattttgaactttttatttgaggagacgaagtgaaaacaaatctataaatatatatttttaaaatatttaacttttttttatggcgtttttctcgtccccctccctgcccaaactccccttccctggggagccctcaggctccccagaactggctgggcccctggggacagagccaccccatgagctcggggtccaccagtgtgtgggggagattctgggtttgcccagtcctgggttgtttccaggagaaagccgggggaggggccctcaggccattccccaacggggtggggagggtgacccacagctctgggcctctttttgccctttagggctgttgctagggagagggaagagggagaccaaatgtcggggttggggtgggagggcgtcaggcagaggcaactgacttcatttgtgccacacgcatgggcattgcagccttgcgctgtcccaggcatgcagctgcctggggcccaagttgcagtgagcagggtggggtctgggagggggtgagaggcaggaatgggggtcagaagaagtgggagcagcttcttgggctgagtgcagccaaaggggagccagaaatgggcagttctcccagggagtgagcagctactgtaacttttttaaattaagacaaaaagccttgaagaaaatgactttatttttctaagtgtaacctcagtatttatgtaatttgtacaggggccatgccccacccccctcctccccctttggggtagaccttgagggtgggccagcataggggggagggtcttttaccctgtgtcagagcctaccttcaccacctatatccagaaggggagctttttcagaaacagggcagcagtggggtgaaattttcttaacccctaagactgccttcagtaggaacaagctggcttctgtgattaggtgaagggatgggggaagattttatgcacagcctagttatcaaggggatgatttgccgacatgtttgagaaccccctaacctctaaccctcattgctgtcttgccccagtttggggtgccaagatggaagtcacctttctgggctttctcctggagatagctggggcttatgggtggctttcaaggctggggcatggcaaatcaggggccagagagcaggggagcttgggactcaggtctgtaactgcccagccccttttctctgctcttgtttcactccaccatcactcactcactccccactcccccacccatggggaggagacctttgatgaattcttcctctccttcccacaaaagacagacccagtgagtgaatcaggcaaagtgcttataatgtgtgttgtgtgagcgtggccttgggaggacatgcgtgtgtcagggatgagttgaggtgatatttttatgtgcagcgacccttggtgtttcccttcctcggtggctctggggtatgtgtgtgtgggtgtgtgcgcctgagtgagtgtgtgtgcttgaatgtgagtgtgtatgtcagtggtttctacttcccctgggatgctgacccaggaatagtggacatggtcacagtcctatgtacagagctttcttttgtattaaaaaaaaatactctttcaataaatgtatcatttttgtgcacagac

SEQ ID NO: 180689 - DNA, 2855 bp, Homo sapiens
  Payload ID: 15587
  Gene Symbol: SRFBP1
  Gene Name: serum response factor binding protein 1
  Uniprot ID: Q8NEF9
  ENST ID: ENST00000339397
  CDS Start-End: 73-1362
gtggcgacgcagccgcggtctgagagaccggttcacgtgcaggcagcggcggatcatattccttcatctaccatggctcagccgggaactctgaacctcaataacgaggttgtgaagatgagaaaagaagtgaagagaattcgagttttagttatccgaaaacttgtcaggagtgttggccgactgaagtcaaaaaagggtactgaagatgcactgttaaaaaaccaaagacgggcgcaaagattgcttgaagaaatccatgccatgaaggaattgaaacctgacatagtaactaaatctgctcttggtgatgatatcaactttgaaaaaatcttcaaaaagccagattctactgcaactgaaagagcaattgccagactagcagtacatcctcttctgaagaaaaagatagatgtgctaaaagctgctgtacaagcctttaaagaagcaagacaaaatgttgctgaagttgagtcatcaaagaatgcttcagaggacaatcattctgagaatactttgtattcaaatgataatggaagtaatttacagcgtgaagcaactgtcatcagtgagcaaaaagtcaaagaaaccaaaatattggcgaagaaaccaatacataattcaaaggaaaaaatagcaaagatggaacatggacctaaagcagtgactattgcaaattctccatcaaagccttcagaaaaggattctgtagtttcccttgagtcccagaagacacctgctgacccaaaactgaaaactctaagtcaaaccaaaaaaaacaaaggatctgatagctcactctctggtaacagtgatggcggagaagaattttgtgaagaggagaaggaatattttgatgatagcacagaagaaaggttttacaagcagtcttccatgtctgaagatagtgatagcggtgacgacttcttcattgggaaagtcagacggacacgaaagaaggaaagtagttgtcattcttcagttaaggaacaaaaaccactagaaaaagtgtttcttaaagaagatacaggtgaaactcatggggatacaagaaatgacaaaatcaagccaagtacagaaaccagaaagttagaatcagtgtttttccactctttatctggatctaaaagctctagaagaaatttcaaagaacaggctccaaaaacaagatccctagattttccacagaatgagcctcagatcaagaatcagtttaataagaagctatcaggaagacttgaaaatacaaaacagcaattgcagctgcctcttcatccttcatgggaagcaagcagaaggcgaaaagaacagcaatctaatattgctgtgtttcaggggaaaaaaattacgtttgatgattgattagtgcctctttctgcaaacttttccatctaaaaaaaaaaatgttttttttaagacaggatctcattctgttgcccagactagagtacaatattgcaatcacagctcactgcagcctcaaactcctgggctcaagtgatcctcccacctctgcctcccaaagggctgggactgcaggtgcatgcactaccatgcccagctttctcaccccaggctctgcagctattacttaaactcgtatttgaataagtctcttggggagaattatagaatgtttgtttttgtatttttttttaaagtaaattcaacttacgcttatataagcctttcacaaatccaatatgtacttaaattgatttttaataatatccctcagactgtttcccttatgaagtaatttggggattttagtgatctcatattttctctttagtgcttatcatgaaatgtgcttcactggttcagctctgttgtttccttaaacataaatgtcaatatatatttaaaataataatggaaacataggaaatcagctatttaaaccagatcacccttgttaaaaatcattcttgttagcaaactaaaatagtaacttttattatggatgtacagataaatattaattttattatagttttaagtacttgtgatcatgtactttttgattctaaaatagttgtctaggacaattttgggattcttaattatattttagttaagaaaattgtttaaatatagcaatacaaccaataatttgttttatgtttcactgcatataaatatttccattaaatcaagaatgtatattatctagtttttactatacttattttaaaatttttgaggaatcatagattctaatttttaagaacaaattctgaaggtggtaggattaaaagaatatttccactgatggctaagcaaagaagttgtaagatgactcactgaggaagggactgctttatacatcacagtactgctatttaaaaggaaaacagaaatttttaaatcccttcaaatgtttcacttttgctatgctgggaaaaattttgaagttcttggtaaactgaataatgctaatccatgtttcctgcacattagttcctttaatggcagggaaggccatctggttaacctgtattcacaaactctcaagagtttctacttatttcaggagcttaagaatttagataactcagccgggcgtggtgactcatgcctataatcccagcactttgggaggctgaggcgggtagatcgctagaggcaaggagttcaaaaccagcctgggcaacatggtgaaaccctgtctctactaaaaatacagaaaattatccaggcgtggtggccggcatctgtaattccagctactcagaaggctgaggcataagaattgcttgaacctgggaggtggaggttgcagtgagccaagattgcaccactgcactccagcctgggtgacagagtatgactgtctcaaaaaaaaaaaaaaa

SEQ ID NO: 180690 - DNA, 2401 bp, Homo sapiens
  Payload ID: 15588
  Gene Symbol: SGK1
  Gene Name: serum/glucocorticoid regulated kinase 1
  Uniprot ID: O00141
  ENST ID: ENST00000237305
  CDS Start-End: 90-1385
ttttttataaggccgagcgcgcggcctggcgcagcatacgccgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatattta

SEQ ID NO: 180691 - DNA, 2414 bp, Homo sapiens
  Payload ID: 15588
  Gene Symbol: SGK1
  Gene Name: serum/glucocorticoid regulated kinase 1
  Uniprot ID: O00141
  ENST ID: ENST00000367857
  CDS Start-End: 234-1499
cagcatacgccgagccggtctttgagcgctaacgtctttctgtctccccgcggtggtgatgacggtgaaaactgaggctgctaagggcaccctcacttactccaggatgaggggcatggtggcaattctcatcggtgagtgcaggaatcttgcgggacttctgctccaggagacgcaaagtggaaattttttgaaagtcccggatcagattagtgtgtgtggcgccggacgttatgaagccgtctaaacgtttctttatttctcctccttcatccacagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaac

SEQ ID NO: 180692 - DNA, 3201 bp, Homo sapiens
  Payload ID: 15588
  Gene Symbol: SGK1
  Gene Name: serum/glucocorticoid regulated kinase 1
  Uniprot ID: O00141
  ENST ID: ENST00000367858
  CDS Start-End: 599-2179
agatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggtagctgggggcggggaggcgtacccttctcccgctcggtaagagccacagcatctccccggagattggccgtatcccaccgtccggcccccagggtcctgcagcggtgatgcatatgtttcggagcaatgatggaaggagaaaagccgctgtcggtggcaactgaaagtggggagaggttgctgcagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttacatata

SEQ ID NO: 180693 - DNA, 2686 bp, Homo sapiens
  Payload ID: 15588
  Gene Symbol: SGK1
  Gene Name: serum/glucocorticoid regulated kinase 1
  Uniprot ID: O00141
  ENST ID: ENST00000413996
  CDS Start-End: 331-1668
gcagattgtacttcttcctttagtgcagagacgacttttatttccgccccctcccctccacattcctgacctctccctcccccttttccctctttctttccttccttcctcctcttccaagttctgggatttttcagccttgcttggttttggccaaaagcacaaaaaaggcgttttcggaagcgacccgaccgtgcacaagggccatttgtttgttttgggactcggggcaggaaatcttgcccggcctgagtcacggcggctccttcaaggaaacgtcagtgctcgccggtcgctctcgtctgccgcgcgccccgccgcccgctgcccatgggggagatgcagggcgcgctggccagagcccggctcgagtccctgctgcggccccgccacaaaaagagggccgaggcgcagaaaaggagcgagtccttcctgctgagcggactggctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaagcttttcctatcgcagtgtttcagttctttattttcccttgtggatatgctgtgtgaaccgtcgtgtgagtgtggtatgcctgatcacagatggattttgttataagcatcaatgtgacacttgcaggacactacaacgtgggacattgtttgtttcttccatatttggaagataaatttatgtgtagacttttttgtaagatacggttaataactaaaatttattgaaatggtcttgcaatgactcgtattcagatgcttaaagaaagcattgctgctacaaatatttctatttttagaaagggtttttatggaccaatgccccagttgtcagtcagagccgttggtgtttttcattgtttaaaatgtcacctgtaaaatgggcattatttatgtttttttttttgcattcctgataattgtatgtattgtataaagaacgtctgtacattgggttataacactagtatatttaaacttacaggcttatttgtaatgtaaaccaccattttaatgtactgtaattaacatggttataatacgtacaatccttccctcatcccatcacacaactttttttgtgtgtgataaactgattttggtttgcaataaaaccttgaaaaatatttaca

SEQ ID NO: 180694 - DNA, 267 bp, Homo sapiens
  Payload ID: 15588
  Gene Symbol: SGK1
  Gene Name: serum/glucocorticoid regulated kinase 1
  ENST ID: ENST00000460769
  CDS Start-End: 1-166
ccctccaggggagccagacttcgagtcttccttgtgtcaaacatgcctgggtgaacatgctttccaaagaggggttctccctcaggagaacgagtcatgttcatgggaaactcaatctgggtgtgaaattctctgcaaaacttctggacaactgacatctccctaaatgtgatattctcatacacccccatcttctgatgtttaaattgtaacctatgacaatacttctagatgtcaaaacaatagtgattaaacattcaacggtta

SEQ ID NO: 180695 - DNA, 1383 bp, Homo sapiens
  Payload ID: 15588
  Gene Symbol: SGK1
  Gene Name: serum/glucocorticoid regulated kinase 1
  ENST ID: ENST00000475719
  CDS Start-End: 58-1221
agcatacgccgagccggtctttgagcgctaacgtctttctgtctccccgcggtggtgatgacggtgaaaactgaggctgctaagggcaccctcacttactccaggatgaggggcatggtggcaattctcatcgctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttga

SEQ ID NO: 180696 - DNA, 1850 bp, Homo sapiens
  Payload ID: 15588
  Gene Symbol: SGK1
  Gene Name: serum/glucocorticoid regulated kinase 1
  Uniprot ID: O00141
  ENST ID: ENST00000528577
  CDS Start-End: 84-1463
gctcccttcctgtacttaaattgccttgatataaagtggggttcataacagaacagggatagccgtctctggctcgtgctctcatgtcatctcagagttccagcttatcagaggcatgtagcagggaggcttattccagccataactgggctctacctccagcctccagaagtaatccccaacctgcatatccttgggcaacccgaagaatgaaagaagaagctataaaaccccctttgaaagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttctcagcaaatcaaccttggcccgtcgtccaatcctcatgctaaaccatctgactttcacttcttgaaagtgatcggaaagggcagttttggaaaggttcttctagcaagacacaaggcagaagaagtgttctatgcagtcaaagttttacagaagaaagcaatcctgaaaaagaaagaggagaagcatattatgtcggagcggaatgttctgttgaagaatgtgaagcaccctttcctggtgggccttcacttctctttccagactgctgacaaattgtactttgtcctagactacattaatggtggagagttgttctaccatctccagagggaacgctgcttcctggaaccacgggctcgtttctatgctgctgaaatagccagtgccttgggctacctgcattcactgaacatcgtttatagagacttaaaaccagagaatattttgctagattcacagggacacattgtccttactgacttcggactctgcaaggagaacattgaacacaacagcacaacatccaccttctgtggcacgccggagtatctcgcacctgaggtgcttcataagcagccttatgacaggactgtggactggtggtgcctgggagctgtcttgtatgagatgctgtatggcctgccgcctttttatagccgaaacacagctgaaatgtacgacaacattctgaacaagcctctccagctgaaaccaaatattacaaattccgcaagacacctcctggagggcctcctgcagaaggacaggacaaagcggctcggggccaaggatgacttcatggagattaagagtcatgtcttcttctccttaattaactgggatgatctcattaataagaagattactcccccttttaacccaaatgtgagtgggcccaacgacctacggcactttgaccccgagtttaccgaagagcctgtccccaactccattggcaagtcccctgacagcgtcctcgtcacagccagcgtcaaggaagctgccgaggctttcctaggcttttcctatgcgcctcccacggactctttcctctgaaccctgttagggcttggttttaaaggattttatgtgtgtttccgaatgttttagttagccttttggtggagccgccagctgacaggacatcttacaagagaatttgcacatctctggaagcttagcaatcttattgcacactgttcgctggaagctttttgaagagcacattctcctcagtgagctcatgaggttttcatttttattcttccttccaacgtggtgctatctctgaaacgagcgttagagtgccgccttagacggaggcaggagtttcgttagaaagcggacgctgttctaaaaaaggtctcctgcagatctgtctgggctgtgatgacgaatattatgaaatgtgccttttctgaagagattgtgttagctccaaag

SEQ ID NO: 180697 - DNA, 553 bp, Homo sapiens
  Payload ID: 15588
  Gene Symbol: SGK1
  Gene Name: serum/glucocorticoid regulated kinase 1
  ENST ID: ENST00000461976
  CDS Start-End: 122-553
aatcaaaaacaactctcctctctcaagccgcctccaggagcgcatcacctggagaagagcgactcgctccccgcgccggccgcggaagagcagccaggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtgagagagccatgtaatcatgccaacatcctgaccaagcccgatccaagaaccttctggactaatgatgatccagctttcatgaagcagaggaggatgggtctgaacgactttattcagaagattgccaataactcctatgcatgcaaacaccctgaagttcagtccatcttgaagatctcccaacctcaggagcctgagcttatgaatgccaacccttctcctccaccaagtccttct

SEQ ID NO: 180698 - DNA, 2594 bp, Homo sapiens
  Payload ID: 15588
  Gene Symbol: SGK1
  Gene Name: serum/glucocorticoid regulated kinase 1
  ENST ID: ENST00000524929
  CDS Start-End: 170-631
cagtagctggtgctgcagaatgcgcgagtgaagaactgagccccgctagattctccatcccgctcagtcttcattaactgtctgcaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttcgagtcttccttgtgtcaaacatgcctgggtgaacatgctttccaaagaggggttctccctcaggagaacgagtcatgttcatgggaaactcaatctgggtgtgaagtaagttcatgttcgctctggatctattctcctggaaaaattctgggcctttgtttttcttgtatttctgccagagtatacccaaaaaataattttttaatgcatatttataaagcttctgaggaagacctagaattgtggtctttgttagctcattatgttatttttttaaagtaggctttatattttagagcagctttaagttcacagcaacattgagcagaaggtacagagattacccatatacgcttgtccccatgcacgtataacctactttgccatcaacattccctagcagagttttatgttagagttcactcttggtgttatacattctatgggtttggactaatgtataataacatgcatccaccattacagtatcatacagttaagtttcactgccctaaaaatcctctgccctccactattcatcccctccttaccctgacccctagcaaccactgatctttttactgtctccatagatttgccttttccagaatgtcatctagctgaatcatgcagtatgttgtattaatgttttacgtgggtccaagactgatacagcaatgtgttggtaaactggcaattcctcagaagtggtttgatcacacaggagatcaagtcttagatgatacaacgattgtaatagtcatctacatgttcgtagcttccattgaaatatttagttcaacacgatttgatccatttacagagcactatgtatacttttcattatttttctcaagctcatatatactcacatttttactaagacttattttccctgctactccaagagttgttttttaaaaattttgttaatccaagaaaaccagataactgattcatcttgcagtttctaagatttcaaaaatttaagattatatttttaacttataacttaattaggcccatatttattttgatttttaaaaccattatataaaatgcttatattatttttaccatcatactgacataaaaatacaatatttagaagacagaacatgttattacaaagtacagttaattgtaagtgatcttccaagtcagtgcatcatagaatgataaacgttaataaccgctcaccttttttatttttagcaaggtaaccattttccagagataaaataatcatttagctgctaaaagactgaagacattaaatctgagttccttttcactctgagttatcacgcaatgtcgctgaatctgtttcataatttgtctactttctttctttcttttttttttttttttgagtttcactcttgttgcccagactggagtgcaatggcacgatctcggctcactgcaacctccgcttcctgagttcaagtaattcttctgcctcagtctcccgagtagctgggattacaggcacccaacaccacgcctggctaatttttgtatttttaatagaaacagggtttctctatgttggtcaggctggtgtcaaactcccaacctcaggtaatccacctgcgtcggctttccaaattgctgggattacaggcatgagccactacgccggccctttttttggggggggtgggggtcggggacagggagacagggggacagagtcttgctctgtaaccctgacttgagtgcagtagtgcaatcataactcactgttacctcaaactcctaggttcaagtgatcctcccacctcaaccctcccaagtaaataagaccacaggcatacgccaacaaacctggctaattaaaaaaaaaaaattttttttgtagaaacagggtgttgtcatactgaccaggctggtcttgaactcctggcttcaagtgatcctcccaaaatgctgggattataggtatgaggcacaatgcccagcctacttgtctactttctacggttattggaaaaatcaaatgagattgatatgaaatgtttcataatctatagaatgccatgcaaatataaatcattattgctcatgtttgctgatttacatattagctaagcctgtgactctgtaacactatattagacttccataactgggttagcactttgctgatccatgaacatttgtcatggtgcatttgctttttagccagatgttggttcaactctaggtttgtcatgaaaaacaataaagacgctaaatgcaa

SEQ ID NO: 180699 - DNA, 560 bp, Homo sapiens
  Payload ID: 15588
  Gene Symbol: SGK1
  Gene Name: serum/glucocorticoid regulated kinase 1
  ENST ID: ENST00000533224
  CDS Start-End: 381-560
aactgctcttcagtgtgccctgagccggctgtgccttctctccatccgctgctcagatattcatgaaccgttgcttcttccagcctcgccttctcgctccctctgcctttctggcgctgttctccctccctccctctggcttctgctctttcttactccttctctcagctgcttaactacagctcccactggaacttgcacaatcaaaaacaactctcctctctcaagccgcctccaggagcgcatcacctggagaagagcgactcgctccccgcgccggccgcggaagagcagccaggaggtaaaccggggaaacagatatgcactaaccaggcgggtgccaacctggatctataactgtgaattccccacggtggaaaatggtaaacaaagacatgaatggattcccagtcaagaaatgctcagccttccaattttttaagaagcgggtacgaaggtggatcaagagcccaatggtcagtgtggacaagcatcagagtcccagcctgaagtacaccggctcctccatggtgcacatccctccaggggagccagacttc

SEQ ID NO: 180700 - DNA, 2498 bp, Homo sapiens
  Payload ID: 15589
  Gene Symbol: SGK2
  Gene Name: serum/glucocorticoid regulated kinase 2
  Uniprot ID: Q9HBY8
  ENST ID: ENST00000341458
  CDS Start-End: 554-1837
agggtggaagcaaggaagacactattcctggccacatagatcagctggtcacaccttctgttgtttggccccgaatagatattggccagtcttgggtctctctgtggccccagcccaaggcttccagggcagctgcctttcctgaggcattgggcagaattccttgtggcaaggagatcgtagcacagagcccagctgggactgcgcacagtaattcagggttgccattgttcctctatgggagtccggagagcccagcctgtgcttcacaaggctatgtggccctaggaaggtccttttttaggccacaggccttccatctgtgaaatgggggatgggttcagactttatgccctgaaaagatccttccagccctggccatcttggacttctggagctaccctggctcacaggggtcttgttgccctgggtgtccccagttcttgaaaagaatcagcctgggaggggccacaccctgaccatccccctttatcccttctgagatgtttgttaggaagtctgggtccaggggatatcatttcttgttccatccatgcaggggttgcttacctcgggtaggaaaccctcaggcggtggcaggtgcacaggtaggggaggatggagagggcagtggtgcctgaagccctggatgggcggagctgaccccccaacaccaactctctcatgcctgctcctccctgtccccccagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 180701 - DNA, 1736 bp, Homo sapiens
  Payload ID: 15589
  Gene Symbol: SGK2
  Gene Name: serum/glucocorticoid regulated kinase 2
  ENST ID: ENST00000373077
  CDS Start-End: 157-1233
attcctgactgggaaggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtggatacactcgggccaggcaccagaaaagcttcttttcgttgggattttaaaaagacagtgaagataatgtcgaacttataccctggagagagaaccatacatggaatactaggcagagatgaatggactttagaatgagacactccggagctggattcctggttttgtcacctaccatttgtgaggtcttcaacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttag

SEQ ID NO: 180702 - DNA, 1906 bp, Homo sapiens
  Payload ID: 15589
  Gene Symbol: SGK2
  Gene Name: serum/glucocorticoid regulated kinase 2
  Uniprot ID: Q9HBY8
  ENST ID: ENST00000373092
  CDS Start-End: 142-1245
ggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 180703 - DNA, 2225 bp, Homo sapiens
  Payload ID: 15589
  Gene Symbol: SGK2
  Gene Name: serum/glucocorticoid regulated kinase 2
  Uniprot ID: Q9HBY8
  ENST ID: ENST00000373100
  CDS Start-End: 461-1564
agggctgggaggttgaacttgagccggtttgggagccaggagcgagtgggtgacaggtcattcctgactgggaaggttgcttgacaagtcaggattgtgcctccagtcagaaggaccatgaagagagagaagagggcagagccgtgcatggggctgctccccaggacctgagcaggaacctggagttttcagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttgatgatatttgtctttgttgtgggtaatactggacatttgttattg

SEQ ID NO: 180704 - DNA, 1915 bp, Homo sapiens
  Payload ID: 15589
  Gene Symbol: SGK2
  Gene Name: serum/glucocorticoid regulated kinase 2
  Uniprot ID: Q9HBY8
  ENST ID: ENST00000423407
  CDS Start-End: 196-1299
agctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaatgtgtaaaatgacagagatgtaacaagctcatagggtatcaatatctcttattgttctatgttg

SEQ ID NO: 180705 - DNA, 676 bp, Homo sapiens
  Payload ID: 15589
  Gene Symbol: SGK2
  Gene Name: serum/glucocorticoid regulated kinase 2
  ENST ID: ENST00000412111
  CDS Start-End: 83-676
actgcctgtcttcggttccaactgctggttctcctagaggcctctcctcagactcgcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgag

SEQ ID NO: 180706 - DNA, 1182 bp, Homo sapiens
  Payload ID: 15589
  Gene Symbol: SGK2
  Gene Name: serum/glucocorticoid regulated kinase 2
  Uniprot ID: Q9HBY8
  ENST ID: ENST00000426287
  CDS Start-End: 1-1182
atgcaggggttgcttacctcgggtaggaaaccctcaggcggtggcaggtgcacagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctag

SEQ ID NO: 180707 - DNA, 2395 bp, Homo sapiens
  Payload ID: 15589
  Gene Symbol: SGK2
  Gene Name: serum/glucocorticoid regulated kinase 2
  ENST ID: ENST00000496343
  CDS Start-End: 142-999
ggttgcttgacaagtcaggattgtgcctccagtcagaaggaccatgaagagagagaagagggcagagccgtgcatggggctgctccccaggacctgagcaggaacctggagttttcagagctgcctgatcattgctacagaatgaactctagcccagctgggaccccaagtccacagccctccagggccaatgggaacatcaacctggggccttcagccaacccaaatgcccagcccacggacttcgacttcctcaaagtcatcggcaaagggaactacgggaaggtcctactggccaagcgcaagtctgatggggcgttctatgcagtgaaggtactacagaaaaagtccatcttaaagaagaaagagcagagccacatcatggcagagcgcagtgtgcttctgaagaacgtgcggcaccccttcctcgtgggcctgcgctactccttccagacacctgagaagctctacttcgtgctcgactatgtcaacgggggagagctcttcttccacctgcagcgggagcgccggttcctggagccccgggccaggttctacgctgctgaggtggccagcgccattggctacctgcactccctcaacatcatttacagggatctgaaaccagagaacattctcttggactgccagggacacgtggtgctgacggattttggcctctgcaaggaaggtgtagagcctgaagacaccacatccacattctgtggtacccctgagtacttggcacctgaagtgcttcggaaagagccttatgatcgagcagtggactggtggtgcttgggggcagtcctctacgagatgctccatggcctgccgcccttctacagccaagatgtatcccagatgtatgagaacattctgcaccagccgctacagatccccggaggccggacagtggccgcctgtgacctcctgcaaagccttctccacaaggaccagaggcagcggctgggctccaaagcagactttgtagcttgagattaagaaccatgtattcttcagccccataaactgggatgacctgtaccacaagaggctaactccacccttcaacccaaatgtgacaggacctgctgacttgaagcattttgacccagagttcacccaggaagctgtgtccaagtccattggctgtacccctgacactgtggccagcagctctggggcctcaagtgcattcctgggattttcttatgcgccagaggatgatgacatcttggattgctagaagagaaggacctgtgaaactactgaggccagctggtattagtaaggaattaccttcagctgctaggaagagcgactcaaactaacaatggcttcaacgagaagcaggtttattttttccagcacataaaagaaaaataatgtttcggagtccaggactggcaggacaggtcatcagatactcagaggctgtatctctgccctgccaaccttgacaaatggcttccaatgttaggtttgctacaagatggttactggagctctagctgcctattttgtgtttagggaagggaaaatggaggaaaggggagaagagcaaagggcgcttttaaagagctttcccaaaagctccacccaatgacttctgcttccatctcactaaccacccacccctacctggaatggaggctgggagatgtggcttatttgctgggtacgtgactatccctaataacaaaggggttctgacactaagacattaggggagaatgttgggtaggcagccagcactcttttaccagagggcctcctggtgtttggattttgatctcaataataaataaataaatacgaaaagtggtttgtttttttacaaatgtgtggttcatactcctgggtggccttattagcttttttggttgggagacaagggaaggaactttcttggatcagtgtgtgctggtgattttattgccttttcctcttaattcaatcccactctttcccttcctcaagtcttgttcacccagcctcctgccccaggaatcacggggaagaagtctgggagaccacagaaaaaacaccaatgacactgagctattagagatcaaaactgggtcaggaagagttcatgttaagctttcacatgtgctaagaacgctgaaagatacacactgatttccatcttaatagtgccagataattgacaaatttgggacaagatgagggagaggtcaaaatccccctaacttcccaaagcaaaaaaacaggagtataatgatcagaaacgtaatagtagtgtcagaagcacacaatcagctgtggacggtgaaacatataatggttctatctgttctgagattgtaaaagcacaattattttcatcaggataaaaaataaaaatgaaaaactatgctgttgaatggaa

SEQ ID NO: 180708 - DNA, 554 bp, Homo sapiens
  Payload ID: 15589
  Gene Symbol: SGK2
  Gene Name: serum/glucocorticoid regulated kinase 2
  ENST ID: ENST00000617268
  CDS Start-End: 525-554
acatatgctgatgtaaatgtacaaatgtggtcacactgacacatacatgcaatcatctacgcagactcatagaaaccgacacaaatacctgaaatacacagccacagacagacacacacggaagcactctatgcacaaaacactcacacagtacacaccatgctgcacataccctgacccaaacagtctaacaagccctgagggtctccagggctgccctggggctattgcccacccctcccaccgtccccgctagggtgagatggtgttccccagggaacagaagtctccagtcccatcttaagctctgccggatcccgcgtgacatcagctagccccctcgcggctgccgggagctgtgagctctgtgctggggccaggccggcaccaggcacagacacttaggcccttgttgggagaacagagagaggctctcttgtccactgcctgtcttcggttccaactgctggttctcctagaggcctctcctcagactcgcagagctgcctgatcattgctacagaatgaactctagcccagctgggaccccaagt

SEQ ID NO: 180709 - DNA, 4055 bp, Homo sapiens
  Payload ID: 15590
  Gene Symbol: SGK3
  Gene Name: serum/glucocorticoid regulated kinase family, member 3
  Uniprot ID: Q96BR1
  ENST ID: ENST00000345714
  CDS Start-End: 124-1614
aggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaa

SEQ ID NO: 180710 - DNA, 4190 bp, Homo sapiens
  Payload ID: 15590
  Gene Symbol: SGK3
  Gene Name: serum/glucocorticoid regulated kinase family, member 3
  Uniprot ID: Q96BR1
  ENST ID: ENST00000396596
  CDS Start-End: 261-1751
ggggcctgcaggtttggcccccgcagggagcgcagctggcgccgctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatc

SEQ ID NO: 180711 - DNA, 477 bp, Homo sapiens
  Payload ID: 15590
  Gene Symbol: SGK3
  Gene Name: serum/glucocorticoid regulated kinase family, member 3
  ENST ID: ENST00000519396
  CDS Start-End: 99-477
ttaaaaaaacagtttcctgctatggccctgaagattcctgccaagagaatatttggtgataattttgatccagtccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatg

SEQ ID NO: 180712 - DNA, 577 bp, Homo sapiens
  Payload ID: 15590
  Gene Symbol: SGK3
  Gene Name: serum/glucocorticoid regulated kinase family, member 3
  ENST ID: ENST00000518388
  CDS Start-End: 193-577
gcacttggtccgagacagaaaacgtttgagttgttccacacacaccccctctaaatgtcgagaagccccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccat

SEQ ID NO: 180713 - DNA, 517 bp, Homo sapiens
  Payload ID: 15590
  Gene Symbol: SGK3
  Gene Name: serum/glucocorticoid regulated kinase family, member 3
  ENST ID: ENST00000521152
  CDS Start-End: 18-517
aaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaat

SEQ ID NO: 180714 - DNA, 666 bp, Homo sapiens
  Payload ID: 15590
  Gene Symbol: SGK3
  Gene Name: serum/glucocorticoid regulated kinase family, member 3
  ENST ID: ENST00000522629
  CDS Start-End: 218-666
gctgggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaaggttcttcttgcaaaacggaaactggatggaaa

SEQ ID NO: 180715 - DNA, 3106 bp, Homo sapiens
  Payload ID: 15590
  Gene Symbol: SGK3
  Gene Name: serum/glucocorticoid regulated kinase family, member 3
  Uniprot ID: Q96BR1
  ENST ID: ENST00000522398
  CDS Start-End: 357-1847
ggcgccgctgggagctggtggcgcggcgcaggtcccggccgagtgtggcgcagcagtggcggcgcttcccattcgccatgcgccgggggtgggtgcccgaagggatttagacatagtggactagtggctgttgcctgtttctagtgaggacttctgctgccctttctgttttgagttcccattctgcaaaccccccctcacatgcggcccctgccgttccctaccaaatatctaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaa

SEQ ID NO: 180716 - DNA, 3306 bp, Homo sapiens
  Payload ID: 15590
  Gene Symbol: SGK3
  Gene Name: serum/glucocorticoid regulated kinase family, member 3
  Uniprot ID: Q96BR1
  ENST ID: ENST00000521198
  CDS Start-End: 538-2028
actgcgggcggagcagagggaaacaccagagtctgtgactccagacaggacccactgtgtcctcttgaactttgcacagcgcgtgacgggggcagacggtgcaccgtggcccggcctttcgcgggggtcctcggggaagagagaggagcgcgggtttcctcggaggcctgagcgggacgcagcctgcagcccctccccgcacgggctgcccccggcccgccgctcgcgccgctctgctgggatccggcgccttccccggctgtcctcggcctcccgcgcgctccgcgggaggagccgccagcggccgtgacgcgtcaaggaggaaacgccggcgcccggcggccctgccgggaaggaggaagcgcagtgcgttcggctccgcgcccgccgcgccgggagcagcaccgcggggccaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagtatcttgcacctgaagtaattagaaaacagccctatgacaatactgtagattggtggtgccttggggctgttctgtatgaaatgctgtatggattgcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctccaaaaaaaaaaagaaaaagtaacaaaaggaaattatttgtttttgaaataccagttcaactttgtggattatttttcctctgaaggaaaagaaaaggcttaatggttaggatttttaagtattcccaaagatctgaagggtaataaaatgtactggattttttaaggtggtaccaaaaatgaatgtctgtcatatatttatattacaaatacattatatttatgttctattcatcttttgaatgtttagtatgctattaagtcattctgaatctttgtatttgcttttgcaaataggtatttcaaagctcttttcctaactggttaagtaaaataaaaaattgagctttctagaatatttgcctaattgggaattaaaaagtaaaataataggccaggcatggtg

SEQ ID NO: 180717 - DNA, 537 bp, Homo sapiens
  Payload ID: 15590
  Gene Symbol: SGK3
  Gene Name: serum/glucocorticoid regulated kinase family, member 3
  ENST ID: ENST00000521960
  CDS Start-End: 212-537
agctggcgccgctgggagctggtggcgcggcgcaggtcccggccgagtgtggcgcagcagtggcggcgcttcccattcgccatgcgccgggggtgggtgcccgaaggtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggt

SEQ ID NO: 180718 - DNA, 2483 bp, Homo sapiens
  Payload ID: 15590
  Gene Symbol: SGK3
  Gene Name: serum/glucocorticoid regulated kinase family, member 3
  Uniprot ID: Q96BR1
  ENST ID: ENST00000520976
  CDS Start-End: 215-1609
gggagctggtggcgcggcgcaggtcccggccgagtgtggcgcagcagtggcggcgcttcccattcgccatgcgccgggggtgggtgcccgaaggttgcatgatggaatttgaacattacttcaagaggttttgtattttggattagttaattgggtttgtcctctgctgactgtttcttcggatgcattttttggtgtgctcttgagggattaaatgcaaagagatcacaccatggactacaaggaaagctgcccaagtgtaagcattcccagctccgatgaacacagagagaaaaagaagaggtttactgtttataaagttctggtttcagtgggaagaagtgaatggtttgtcttcaggagatatgcagagtttgataaactttataacactttaaaaaaacagtttcctgctatggccctgaagattcctgccaagagaatatttggtgataattttgatccagattttattaaacaaagacgagcaggactaaacgaattcattcagaacctagttaggtatccagaactttataaccatccagatgtcagagcattccttcaaatggacagtccaaaacaccagtcagatccatctgaagatgaggatgaaagaagttctcagaagctacactctacctcacagaacatcaacctgggaccgtctggaaatcctcatgccaaaccaactgactttgatttcttaaaagttattggaaaaggcagctttggcaaggttcttcttgcaaaacggaaactggatggaaaattttatgctgtcaaagtgttacagaaaaaaatagttctcaacagaaaagagcaaaaacatattatggctgaacgtaatgtgctcttgaaaaatgtgaaacatccgtttttggttggattgcattattccttccaaacaactgaaaagctttattttgttctggattttgttaatggaggggagctttttttccacttacaaagagaacggtcctttcctgagcacagagctaggttttacgctgctgaaattgctagtgcattgggttacttacattccatcaaaatagtatacagagacttgaaaccagaaaatattcttttggattcagtaggacatgttgtcttaacagattttgggctttgtaaagaaggaattgctatttctgacaccactaccacattttgtgggacaccagagcctcctttttattgccgagatgttgctgaaatgtatgacaatatccttcacaaacccctaagtttgaggccaggagtgagtcttacagcctggtccattctggaagaactcctagaaaaagacaggcaaaatcgacttggtgccaaggaagactttcttgaaattcagaatcatcctttttttgaatcactcagctgggctgaccttgtacaaaagaagattccaccaccatttaatcctaatgtggctggaccagatgatatcagaaactttgacacagcatttacagaagaaacagttccatattctgtgtgtgtatcttctgactattctatagtgaatgccagtgtattggaggcagatgatgcattcgttggtttctcttatgcacctccttcagaagacttatttttgtgagcagtttgccattcagaaaccattgagcaaaataagtctatagatgggactgaaacttctatttgtgtgaatatattcaaatatgtataactagtgcctcatttttatatgtaatgatgaaaactatgaaaaaatgtattttcttctatgtgcaagaaaaatagggcatttcaaagagctgttttgattaaaatttatattcttgtttaataagcttatttttaaacaatttaaaagctattattcttagcattaacctatttttaaagaaaccttttttgctattgactgttttttccctctaagtttacactaacatctacccaagatagactgttttttaacagtcaatttcagttcagctaacatatattaatacctttgtaactctttgctatggcttttgttatcacaccaaaactatgcaattggtacatggttgtttaagaagaaaccgtatttttccatgataaatcactgtttgaaatatttggttcatggtatgatcgaaatgtaaaagcataattaacacattggctgctagttaacaattggaataactttattctgcagatcatttaagaagtaacaggccgggcgcggtggctcacgcctgtaatcccagcactttgggaggctgaggcgggcagatcacctgaggtcaggagttggagaccagcctgaccaacatggacaaaccccgtctctactaaaaatacaaaattggcagggtgtggtggcacatgcctataatcccagctacttgggaggctaaggcaggagaatcgcttgaacccgggaggcggaggttgcagtgagccgagatcgcaccattgcactcctgcctgggcaacaagagtgaaactccatctcc

SEQ ID NO: 180719 - DNA, 1852 bp, Homo sapiens
  Payload ID: 15591
  Gene Symbol: SARS
  Gene Name: seryl-tRNA synthetase
  Uniprot ID: P49591
  ENST ID: ENST00000234677
  CDS Start-End: 76-1620
gcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggaggg

SEQ ID NO: 180720 - DNA, 1882 bp, Homo sapiens
  Payload ID: 15591
  Gene Symbol: SARS
  Gene Name: seryl-tRNA synthetase
  ENST ID: ENST00000369923
  CDS Start-End: 12-1622
gaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtagatttcgggcagacaacttgaacaagctgaagaacctatgcagcaagacaatcggagagaaaatgaagaaaaaagagccagtgggagatgatgagtctgtcccagagaatgtgctgagtttcgatgaccttactgcagacgctttagctaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaagattgaacagtttgtgtactcatcaccccatgacaacaagtcatgggagatgtttgaagagatgattaccaccgcagaggagttctaccagtccctggggattccttaccacattgtgaatattgtctcaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaagagaaagaataatctccatttatctacacagaacaagttggaggcttccctcttctcacccaagaaggtggagtttgtccatatgctcaatgctaccatgtgcgccactacccgtaccatctgcgccatcctggagaactaccagacagagaagggcatcactgtgcctgagaaattgaaggagttcatgccgccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccc

SEQ ID NO: 180721 - DNA, 2057 bp, Homo sapiens
  Payload ID: 15592
  Gene Symbol: SARS2
  Gene Name: seryl-tRNA synthetase 2, mitochondrial
  Uniprot ID: Q9NP81
  ENST ID: ENST00000221431
  CDS Start-End: 161-1717
tgaagaggcgggacacagacgacgattgggcgacgaaggactctatcgcggtcaactttcctcaggatctgattggctcgtcacggtcaggttcgctgccttgcaattggtctaaacgcggagtgggcgggacgaagtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggacaaa

SEQ ID NO: 180722 - DNA, 1886 bp, Homo sapiens
  Payload ID: 15592
  Gene Symbol: SARS2
  Gene Name: seryl-tRNA synthetase 2, mitochondrial
  ENST ID: ENST00000430193
  CDS Start-End: 23-1579
gccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggctggtatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctg

SEQ ID NO: 180723 - DNA, 1118 bp, Homo sapiens
  Payload ID: 15592
  Gene Symbol: SARS2
  Gene Name: seryl-tRNA synthetase 2, mitochondrial
  ENST ID: ENST00000455102
  CDS Start-End: 25-735
gtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggaccccaagtaccagggtctgcgggcacgtggccgggagatccggaaggagcttgttcacctgtaccccagggaggcccagcttgaggagcagttctacctgcaggcgctgaagctgcccaaccagacccacccagacgtgcccgtcggggatgagagccaggctcgagtgctccacatggtcggagacaagccaggcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttc

SEQ ID NO: 180724 - DNA, 665 bp, Homo sapiens
  Payload ID: 15592
  Gene Symbol: SARS2
  Gene Name: seryl-tRNA synthetase 2, mitochondrial
  ENST ID: ENST00000598831
  CDS Start-End: 1-564
atgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttcctt

SEQ ID NO: 180725 - DNA, 565 bp, Homo sapiens
  Payload ID: 15592
  Gene Symbol: SARS2
  Gene Name: seryl-tRNA synthetase 2, mitochondrial
  ENST ID: ENST00000593754
  CDS Start-End: 24-296
tgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcgcctgagtgcagtcgcacaatctccggtcactgcaacctccgcctccttgattcaagtgatcgtcgtgcctcagtctcccaaatctcgacatggcaggagctgaggcagctgcaggagcagatccggagcctggaggaagagaaggcagctgtgactgaggcagtgcgggccctgctggcaaaccaggacagtggtgaagtgcagcaggtgcggctggatccaggtgctggctccatatttggtcctacgttcctcccattcccaggccagcttt

SEQ ID NO: 180726 - DNA, 1631 bp, Homo sapiens
  Payload ID: 15592
  Gene Symbol: SARS2
  Gene Name: seryl-tRNA synthetase 2, mitochondrial
  ENST ID: ENST00000594171
  CDS Start-End: 308-1294
aaaatggggagccaagtgtgaatcggacggggtcagggctggggtgtggtggagctcttgcgtttagagagagagatctcgacatggcaggagctgaggcagctgcaggagcagatccggagcctggaggaagagaaggcagctgtgactgaggcagtgcgggccctgctggcaaaccaggacagtggtgaagtgcagcagggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctggagttcaggagaccccggacacctgggacctgtgttgctgagcccgtcctgacatctgtgttcttcctgtcagctccacgcccgggcccctggaccacggggtccacctctcctctgtccttgctgcctcagagtcagtcactgaccctgttatcattgagggtcccagtgggaagcaggacgtctgggctttacggttctagggacaggagaagcagaggaagaggcttccatccctccttccttctttcctcctacagtgctgagcaaaaagtccccaataaatggtcaggac

SEQ ID NO: 180727 - DNA, 541 bp, Homo sapiens
  Payload ID: 15592
  Gene Symbol: SARS2
  Gene Name: seryl-tRNA synthetase 2, mitochondrial
  ENST ID: ENST00000598343
  CDS Start-End: 24-431
tgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcagggaggcccagcttgaggagcagttctacctgcaggcgctgaagctgcccaaccagacccacccagacgtgcccgtcggggatgagagccaggctcgagtgctccacatggtcggagacaagccag

SEQ ID NO: 180728 - DNA, 1630 bp, Homo sapiens
  Payload ID: 15592
  Gene Symbol: SARS2
  Gene Name: seryl-tRNA synthetase 2, mitochondrial
  Uniprot ID: Q9NP81
  ENST ID: ENST00000600042
  CDS Start-End: 26-1588
agtgccgccttgttcccggtccaagatggctgcgtccatggcgcggcgcttgtggcctttgctgactcgtcgggggttccggccccggggaggctgcatctccaacgatagtccaaggagaagtttcactacagagaaacgaaaccggaacctcctgtacgagtatgcgcgcgagggctacagcgcactccctcagctggacatagagcggttctgcgcatgcccagaagaggccgcacacgccctggagctccgcaagggggagctgcgctcggcggacctgcccgcgatcatctcgacatggcaggagctgaggcagctgcaggagcagatccggagcctggaggaagagaaggcagctgtgactgaggcagtgcgggccctgctggcaaaccaggacagtggtgaagtgcagcaggtgcggctggatccaggtgctggctccatatttggtcctacgttcctcccattcccaggccagctttctctccttgtggaggcccagcttgaggagcagttctacctgcaggcgctgaagctgcccaaccagacccacccagacgtgcccgtcggggatgagagccaggctcgagtgctccacatggtcggagacaagccagttttctccttccaacctcggggccacctggaaattggcgagaaactcgacatcatccgtcagaagcgcctgtcccacgtgtctggccaccggtcctattacctgcgcggggctggagccctcctgcagcacggcctggtcaacttcacattcaacaagcttctccgccggggcttcacccccatgacggtgccagaccttctccgcggagcagtgtttgaaggctgtgggatgacaccaaatgccaacccatcccaaatttacaacatcgaccctgcccgcttcaaagatctcaacctggctggaacagcggaggtggggcttgcaggctacttcatggaccacaccgtggccttcagggacctgccagtcaggatggtttgctccagcacctgctaccgggcagagacaaacacgggacaggaaccccgggggctgtatcgagtacaccacttcaccaaggtggagatgtttggggtgacaggccctgggctggagcagagctcacagctgctggaggagttcctgtcccttcagatggagatcttgacagagctgggcttgcacttccgggtcctggatatgcccacccaagaactgggcctccccgcctaccgcaagtttgacattgaggcctggatgccaggccgaggccgctttggagaggtcaccagtgcttccaactgcacagacttccagagccgccgcctccacatcatgttccagaccgaggctggggagctgcagtttgcccacacggtgaacgccaccgcctgtgctgtcccccgccttctcatcgcgctcctggagagtaaccagcagaaggacggctcagtgctcgtgccccctgccctccagtcctacctcggcactgatcggatcacagcccctacccacgtgcctctccagtacatcggccccaaccagccccggaagcctgggctgcctggccagcctgctgtaagctaagaacccacccacagcagccctcgggggtgtcactgcttcctg

SEQ ID NO: 180729 - DNA, 541 bp, Homo sapiens; identical to SEQ ID NO: 180727
  Payload ID: 15592
  Gene Symbol: SARS2
  Gene Name: Seryl-tRNA synthetase 2, mitochondrial
  ENST ID: ENST00000635040
  CDS Start-End: 24-431

SEQ ID NO: 180730 - DNA, 1886 bp, Homo sapiens; identical to SEQ ID NO: 180722
  Payload ID: 15592
  Gene Symbol: SARS2
  Gene Name: Seryl-tRNA synthetase 2, mitochondrial
  ENST ID: ENST00000635472
  CDS Start-End: 23-1579

SEQ ID NO: 180731 - DNA, 665 bp, Homo sapiens; identical to SEQ ID NO: 180724
  Payload ID: 15592
  Gene Symbol: SARS2
  Gene Name: Seryl-tRNA synthetase 2, mitochondrial
  ENST ID: ENST00000635594
  CDS Start-End: 1-564

SEQ ID NO: 180732 - DNA, 1631 bp, Homo sapiens; identical to SEQ ID NO: 180726
  Payload ID: 15592
  Gene Symbol: SARS2
  Gene Name: Seryl-tRNA synthetase 2, mitochondrial
  ENST ID: ENST00000634916
  CDS Start-End: 308-1294

SEQ ID NO: 180733 - DNA, 565 bp, Homo sapiens; identical to SEQ ID NO: 180725
  Payload ID: 15592
  Gene Symbol: SARS2
  Gene Name: Seryl-tRNA synthetase 2, mitochondrial
  ENST ID: ENST00000635353
  CDS Start-End: 24-296

SEQ ID NO: 180734 - DNA, 1630 bp, Homo sapiens; identical to SEQ ID NO: 180728
  Payload ID: 15592
  Gene Symbol: SARS2
  Gene Name: Seryl-tRNA synthetase 2, mitochondrial
  ENST ID: ENST00000635245
  CDS Start-End: 26-1588

SEQ ID NO: 180735 - DNA, 1118 bp, Homo sapiens; identical to SEQ ID NO: 180723
  Payload ID: 15592
  Gene Symbol: SARS2
  Gene Name: Seryl-tRNA synthetase 2, mitochondrial
  ENST ID: ENST00000634481
  CDS Start-End: 25-735

SEQ ID NO: 180736 - DNA, 2057 bp, Homo sapiens; identical to SEQ ID NO: 180721
  Payload ID: 15592
  Gene Symbol: SARS2
  Gene Name: Seryl-tRNA synthetase 2, mitochondrial
  ENST ID: ENST00000634687
  CDS Start-End: 161-1717

SEQ ID NO: 180737 - DNA, 2718 bp, Homo sapiens
  Payload ID: 15593
  Gene Symbol: SESN1
  Gene Name: sestrin 1
  Uniprot ID: Q9Y6P5
  ENST ID: ENST00000302071
  CDS Start-End: 336-1616
tgaaacagcctgtggatatgccccctcgattgtcttgtcttgtgaaaacagattatttagccaccttcatcccctttgcctcctacttaaaagagagagaaagaaaaaaaacacatttgactcagggaagagatgatgttgcctggaataagtgtgtcctgcaagctctatgacgttatgcacagcgtttactcttgcgtattaagccatcccttttctgaattgtcctttagaaagaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaa

SEQ ID NO: 180738 - DNA, 2676 bp, Homo sapiens
  Payload ID: 15593
  Gene Symbol: SESN1
  Gene Name: sestrin 1
  Uniprot ID: Q9Y6P5
  ENST ID: ENST00000356644
  CDS Start-End: 96-1574
gccgtccgtgctgactgaggcgctgcagccaggagccgcggccggctgcccagcgctcgccgcctccgcgcgtccgcagccgtccccgcgccgacatgcgcttggccgccgccgcgaacgaggcgtacacggcccctttggcggtctcggggctgctgggctgcaagcagtgcggcgggggccgcgaccaggacgaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaa

SEQ ID NO: 180739 - DNA, 3509 bp, Homo sapiens
  Payload ID: 15593
  Gene Symbol: SESN1
  Gene Name: sestrin 1
  Uniprot ID: Q9Y6P5
  ENST ID: ENST00000436639
  CDS Start-End: 747-2402
gattgccagggccgccctgtgccctctggctcggcggtggtgggcgagggctcagggatcggagaagtagcgtcttcccgggggtgccgaattggcggggctgggggacgctttttttcaccgccgcccgccgagactacggctgcccgagactgccgccctccgacagcgcccaagcctccggccgctgcggccagtgggccagggttcggcgagccttccctgccggcgccggccggctgctgaggcgctgggaggagctgcggagggcggggactggtgtcggagaaggggcggggtgggaacgccggagagaacccggtggctgcacagacaaaaaagccccgaatggctggagggcgttcagctgttaacagccttttggggcagagcacggatttgacagctccacaacgtgaggatatccactgaccccgcgagacggaggagaacgcttccccgaaattctctgcccaccaaagccagcgctgcaaggttgcaactttcaaactttgtttttccagaaagaagactgccctttcgtgtacaaggagagggtgagagggtgacctagcttgtagatcggctgaaggcaccagtggttccaaatgtcacccagatgtgtgttttcatgacgatttgatttctctgattttatttttacatttttcattttaaaaatacaaagcaatttttttggggcatgctgaaaggtaactgaagaccgcaaaggaaaaactattgtcatggctgaaggagagaatgaagtgagatgggatggactctgcagcagagattcaactactagggagacagcattggaaaacattaggcaaaccattttgaggaaaaccgagtatcttcgttcggtgaaagaaacacctcatcgtccatcagacgggctttcaaataccgagtcttcggatgggttgaataagctacttgctcatctgcttatgctttctaagaggtgtcccttcaaagatgtgagagagaaaagtgagtttattctgaagagcatccaggaacttggcattagaattcctcgaccactaggacagggaccaagcagattcatcccagaaaaggagatcctccaagtggggagtgaagacgcacagatgcatgctttatttgcagattcttttgctgctttgggccgtttggataacattacgttagtgatggttttccacccacaatatttagaaagtttcttaaaaactcagcactatctactgcaaatggatgggccgttacccctacattatcgtcactacattggaataatggctgcggcaagacatcagtgctcctacttagtgaacctgcatgtaaatgatttccttcatgttggtggggaccccaagtggctcaatggtttagagaatgctcctcaaaaactacagaatttaggagaacttaacaaagtgttagcccatagaccttggcttattaccaaagaacacattgagggacttttaaaagctgaagagcacagctggtcccttgcggaattggtacatgcagtagttttactcacacactatcattctcttgcctcattcacattcggctgtggaatcagtccagaaattcattgtgatggtggccacacattcagacctccttctgttagcaactactgcatctgtgacattacaaatggcaatcacagtgtggatgagatgccggtcaactcagcagaaaatgtttctgtaagtgattctttctttgaggttgaagccctcatggaaaagatgaggcagttacaggaatgtcgagatgaagaagaggcaagtcaggaagagatggcttcacgttttgaaatagaaaaaagagagagtatgtttgtcttctcttcagatgatgaagaagttacaccagcaagagctgtatctcgtcattttgaggatactagttatggctataaagatttctctagacatgggatgcatgttccaacatttcgtgtccaggactattgctgggaagatcatggttattctttggtaaatcgcctttatccagatgtgggacagttgattgatgaaaaatttcacattgcttacaatcttacttataatacaatggcaatgcacaaagatgttgatacctcaatgcttagacgggcaatttggaactatattcactgcatgtttggaataagatatgatgattatgactatggtgaaattaaccagctattggatcgtagctttaaagtttatatcaaaactgttgtttgcactcctgaaaaggttaccaaaagaatgtatgatagcttctggaggcagttcaagcactctgagaaggttcatgttaatctgcttcttatagaagctaggatgcaagcagaactcctttatgctctgagagccattacccgctatatgacctgatgcctttccttcattaaagatgattctggaatgatcagcagatatagtctacaagggggaaggtactaagccccaggaccaatggtagacaaaataattcagaaatccattgtgccatgattcctttagtttctgctatttttctgtggaaaaccactgctggcacaagcagtgactgtttggcagcttcaagtttagagctgtgaagacaggctgccattcacagtattttgctttttgacagtacaagatgctgtgtaactgttttaatacagcaaatagtaactctccaaatcctgttgcttttatgttaaataagataacaagaattggagcatgcaaagaatgggacttggataatgacttaagctttatatgtaaagaattttagaagatcttggtgctgctattcctgctggaggaatgaatagatggctgtttcagttaagctattagtaataaaagtgaacattgctactatctgagcctacatacataacttgtgtgatttcaaattaaacttgcattatgtgttaattttcttgcatctaaaaaagcatagaattcctactcacacagctcagcaacaaccattttgatggtaacagttaatttctttcattagttttttaaattcagggttctggatattaaattaaaatggcattcttaaagattttcttcaaaaagcaatcctaaatgaaagtgtgtaaattataagaagctggcgatcttttgatatgctgtttcacaggatcctgacactggagggcagctgtcttgtgcattacttgtgtttccagcaccaaagttgtgggacatgttgctgtagactgctgcgcagtcctgggtgcattcagtctctctgcctctgcctgcctcctggtccccactttaaaggctgtgcagctccttaaataataaagctggaaaatatttttagtcgggttatcaaatttgatttacaaaaacgctaactttgtttgaaatgcaaacaggtttgaaaatatgtattaagtactttgtattctggaagcgtgaattgcttttgaagtctgtcagtattactggtatttttaaataaagaagaatttttctccaatttta

SEQ ID NO: 180740 - DNA, 3453 bp, Homo sapiens
  Payload ID: 15594
  Gene Symbol: SESN2
  Gene Name: sestrin 2
  Uniprot ID: P58004
  ENST ID: ENST00000253063
  CDS Start-End: 322-1764
tccgcggcggggatgctgaggagcgctgggtccgggagcagccctggcccctgcggacttccgaggccgtgaaaacccctgcgctgcggcccttcccaggcccccgaggccgttcgccgttcccgaagcccgactgggggaagagtccagcaccaaagcggccgttctcggattccggagcgttctggagccccgagagacgccccggggttctagaagctccccggcggcgcccagtcccggcttcattcgggcgtccctccgaaacccactcgggtgcacgggtcgtcggcgagccgcgaccgggtcctggcgcgcaccatgatcgtggcggactccgagtgccgcgcagagctcaaggactacctgcggttcgccccgggcggcgtcggcgactcgggccccggagaggagcagagggagagccgggctcggcgaggccctcgagggcccagcgccttcatccccgtggaggaggtccttcgggagggggctgagagcctcgagcagcacctggggctggaggcactgatgtcctctgggcgagtagacaacctggcagtggtgatgggcctgcaccctgactactttaccagcttctggcgcctgcactacctgctgctgcacacggatggtcccttggccagctcctggcgccactacattgccatcatggctgccgcccgccatcagtgttcttacctggtaggctcccacatggccgagtttctgcagactggtggtgaccctgagtggctgctgggcctccaccgggcccccgagaagctgcgcaaactcagcgagatcaacaagttgctggcgcatcggccatggctcatcaccaaggaacacatccaggccttgctgaagaccggcgagcacacttggtccctggccgagctcattcaggctctggtcctgctcacccactgccactcgctctcctccttcgtgtttggctgtggcatcctccctgagggggatgcagatggcagccctgccccccaggcacctacaccccctagtgaacagagcagccccccaagcagggacccgttgaacaactctgggggctttgagtctgcccgcgacgtggaggcgctgatggagcgcatgcagcagctgcaggagagcctgctgcgggatgaggggacgtcccaggaggagatggagagccgctttgagctggagaagtcagagagcctgctggtgaccccctcagctgacatcctggagccctctccacacccagacatgctgtgctttgtggaagaccctactttcggatatgaggacttcactcggagaggggctcaggcaccccctaccttccgggcccaggattatacctgggaagaccatggctactcgctgatccagcggctttaccctgagggtgggcagctgctggatgagaagttccaggcagcctatagcctcacctacaataccatcgccatgcacagtggtgtggacacctccgtgctccgcagggccatctggaactatatccactgcgtctttggcatcagatatgatgactatgattatggggaggtgaaccagctcctggagcggaacctcaaggtctatatcaagacagtggcctgctacccagagaagaccacccgaagaatgtacaacctcttctggaggcacttccgccactcagagaaggtccacgtgaacttgctgctcctggaggcgcgcatgcaagccgctctgctgtacgccctccgtgccatcacccgctacatgacctgactcctgagcaggacctgggcccggttcagctccccacaaggacttctctgtctggagacagccccagacccttttgtgtcccatgcccaccctccccacgctgcagtgggcttgtgtgtgatgtgcagtcccgaagccacaccctcccttttcctcactggaatggacagttcattgcactgactctgggatctcagccctgctcctgggagctggaagagcacttggagatcctaagggaccacacccttcctccttcccctgcccacagaggcagagggcacaggaaagaagccgggccaagctcggaattaatgtgccacaagtgttgtggccttcctgaactgggaagtccctggctggcccccgggggagaggggcaaatgcctccgggactgacactccaggcagctttgccttctctcccctgtcatttccagatttcattacctcctacttgccattcacccatcaatgtgaaagtcagggtcacagctggtctgtgtgtccagttccctaaaagcctgttctgttgggcagcctgaggctgttgcccgaatcctagttcagttttttgacttcctttgccctttttcccttttctccatgcttaatggtgtgaggcgtcaggagagaggccaagtacataaaaaaaaaaaaagcagattatctctagagagtttgagcctttgctggtcacattgccttctgaagaggagggagtattagattataaatcctctttattttggtcctttatgcttgaggttccaacctggagccacagtgtgtgagaggaggaggagagggagaattctgttctcccagagctgcacctgcctcgcagaggccagcaccccactctcctgcctccagtggccctgccgcagatgtctcccaaaaagttgagcctttctagatggcttaggtggcaccatggctcagcaggaggggcgggaggcaccagggttcttgtttggaccctgcccctgggccatggccaggtgaccatggctacattgccaaacctctgactgccacagctgcagactgagagggtgggtctgagtccccacaatgtctgaagctgcccctgggattctcaggccaacctgccaacagcaagcggattttcttgcaagatcagggaccccatttctgcagccagtgtctcctgggtgccttctgaggactcccacccccatcccagtatctcatctgtcccctctcctggggcttaagtgggttgcttccaggcagaagcagccaaggaccgattccaggcactttctgtagcaaatgactgtgaattacgacttctcttgcccttcttctagcagtctgtgcctcctctctgaccagtttggagggcactgaagaaaggcaagggccgtgctgctgctgggcggggcaggagaggagcctggccagtgtgccacattaaatacccgtgcaggcgcggagaagcaaccggcacccccttccggcctgaaagccctccctgcaagaaggtgtgcaggagagaagaggccccggcatggggatctgggttctagagggcatgtgatgactgtaaatgttcactgggtgggtagggagtggtatccagtgttcaagtgcagaaatctttggctttgctaccagttccatatgatgagaaataaacgttcgctgaggttttgtttcata

SEQ ID NO: 180741 - DNA, 1710 bp, Homo sapiens
  Payload ID: 15595
  Gene Symbol: SESN3
  Gene Name: sestrin 3
  Uniprot ID: P58005
  ENST ID: ENST00000278499
  CDS Start-End: 542-1603
aaacaggtgatgtcataatgcacagtcctgtggccacggccatggccgggtggggagctgggctccagtgagcacagagctccttgccagtaggcgatgcaagttatctctggggcccggaggacacgagtgaggaccgggcaccaatcaggttctcgctctgcgccggcctttgttctcactcgggagcaggttgcgggcgtctagcatcgggaacccgcattcgactcggacgcgcattgctagccccttcgggagacctggctcccctacccgtctgtcccgccacactcggtcagcctgcgctttccccagtcaagtctgccttctctccgcagaacgtggacgctaaaaccctgacttaccattttaagctttagaagaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatgaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtc

SEQ ID NO: 180742 - DNA, 1408 bp, Homo sapiens
  Payload ID: 15595
  Gene Symbol: SESN3
  Gene Name: sestrin 3
  Uniprot ID: P58005
  ENST ID: ENST00000416495
  CDS Start-End: 187-1152
cgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcaggtgcttttttgcacttttttgccttttagttgttcttagaaccctgacagggcaacttcagtgttttccatgtggatatgtaaaaatgattctgctaccatctttctcttatttagttctcctcttctatcttaccctcatgctattgctttccctcaggctggttcatccttgaatgtatttcagattgagttgagagaaactttcagctttgtagttcatactctatcctggataaaatgttatttaaagcagatcagttacttataaagttagatagacata

SEQ ID NO: 180743 - DNA, 607 bp, Homo sapiens
  Payload ID: 15595
  Gene Symbol: SESN3
  Gene Name: sestrin 3
  ENST ID: ENST00000542176
  CDS Start-End: 396-607
ataatgcacagtcctgtggccacggccatggccgggtggggagctgggctccagtgagcacagagctccttgccagtaggcgatgcaagttatctctggggcccggaggacacgagtgaggaccgggcaccaatcaggttctcgctctgcgccggcctttgttctcactcgggagcaggttgcgggcgtctagcatcgggaacccgcattcgactcggacgcgcattgctagccccttcgggagacctggctcccctacccgtctgtcccgccacactcggtcagcctgcgctttccccagtcaagtctgccttctctccgcagaacgtggacgctaaaaccctgacttaccattttaagctttagaagagccaagagcagccaattagagcataatggacaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagtt

SEQ ID NO: 180744 - DNA, 9558 bp, Homo sapiens
  Payload ID: 15595
  Gene Symbol: SESN3
  Gene Name: sestrin 3
  Uniprot ID: P58005
  ENST ID: ENST00000536441
  CDS Start-End: 338-1816
gaggcgctgcggcggcggtggtggcggtggcagcggtggcggctgctcgtcctagcctggcgggggcgggggtctggaagatgggggcgggtggaacaacgggccggtgaggagcagccgccgccgtctccgccgtcgctggggcagctgccgcggtggtcgcctctggcagtgccgctagctttcaggcagtcgcctctcctcccgacatcccgccttgaggaggctgaggcggaatcgcggctggcggcggggggacggaccggccctgcagtggccgcagtgacagcccggacccggccctccgcccgctctcgcctcggcgcccgcagccacgatgaaccggggcggcggcagcccgtcggccgccgccaactacctgctctgtaccaactgccggaaagtgctgcggaaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgctagcacatcgaccttggctgatcacaaaagagcacattcagaaacttgtcaaaactggagaaaataattggtctctgcctgaactggtacatgctgtggtcctcctggcacattatcatgctttggcaagctttgtttttggtagtggtatcaatccagagagagatccagaaatctccaatggattcaggctaatatcagtcaacaatttctgcgtttgtgatcttgctaatgacaacaacatagagaatgcatctctttcaggcagcaactttgggattgtggattctctaagtgagctagaggccttaatggaaaggatgaaaagacttcaagaagaaagggaagatgaagaggcgtctcaagaagaaatgagcactcgttttgaaaaggagaagaaagaaagtctttttgtggtctctggagatacttttcattcatttcctcattcagattttgaggatgacatgattataacatctgatgtctctcgatatattgaagaccctggttttgggtatgaagactttgccagacgaggagaagagcatttgccaacattccgagctcaggactatacctgggaaaatcatgggttctccctggtgaacagactttattctgacattggacatcttcttgatgaaaagtttcggatggtctacaatctcacatataacactatggccacccatgaggatgttgacacaaccatgctgcgcagagctttatttaactatgttcactgtatgtttggaatcaggtatgatgactatgattatggagaagttaatcaattacttgaaagaagcctgaaggtttacattaagacagtgacctgctatcctgagagaactacaaaacgcatgtatgatagttactggcggcagttcaaacactcagaaaaagttcatgtcaatctacttttaatggaagcacgaatgcaagctgaacttctttatgctcttcgtgccataactcggcatttgacctgaagtatcacccaaggaaaatgtcatacatgtgtaaagacctttcacataagataaacattgaagctatttgtgatatagcatcaaaaattattcagttctctagtgtcaaagtttagccgtttgtttttttttttttgttttttgcggctgtaatgtgcaatgatgtgttttattttccttgatgcttaacattactaacaattgcaaaaataatactgaggagcactactttgcattgtttgtagttggagttttggatactgatcataaatcatgaatctggcgtattaatgcttaacttcagcgcctttgggttgtgtgtatgtgtattttttctccccccaccccgcccttttttttttaagaataaggacaagtgcttacaatctgctcaagcaattgtttttcagatattggaattcagcaaagagtgacctctctggccattctaaaactttaatgttgtgtcctaaatctggtggaggaaaagcatgcgctgttgaaccaagctgctcactggacacatatttgtgtccccaggagattatttgtcaggcactgttttttatttgtttgtttgttcatttattgttgttttactgctattggcgataacatgaaatgtgatacagctattgcccataatttaatgtgaaattaatcatgatgaattctatagcatgctactgaaatgccaaattcagctattttctttctcttctaaaatggaagtttcagttttccatatcagatgtatataagtggaattataacacaatcctatcactgacagtaatcctcagtcaccttaaataatcagtgctcacagtgctgcttacagttcatttagttggcacatataaacctgtacccacacaagactgaccaaaaattttctttgcacatttttcctttctcatagtttttttctatatttcgttaagcaaaggaaggttaatatgcctatttttcctgttaggcttttagaaattattttccatgacttttgttcttataataggttagacagtttatttttcaaaggtaaaaattgtgtttctatgcattaatgtgattgaactacaaaaacagagtgcaatatgttcaaaaaatactcaactaaactttccccctgtcatatcactgcaaaagtgtccttttaaacagagccataaagaaatttttttcaaatttctttattgcacaggcttttttcagttttacctttctgggattgaacaatgttcctttcataatgccaaagcattcccttccccagaaaaatctccttggacaactggtttaaaaacgttattaagtcataggggaggaataagcggccaaaaagtcacatttttgcattggtttacgttgcttgattagactatcttcagagagcacattatgtgtttatagctttaatttgtattatgtcaatgaaccagtgaagtgcctaaagagatgcttacaactatccagtaggacacaactgcactgctttttaaacactttttggttagttaagggtgacttgaattgtacacatacatgctaatttttgaaaacttatccatttttcatagtaaataatatagataaaattttctgttagagttcccgcaaatatttcattttagacttacttgtgatataagatttaacttttcttttgtgaaagaatcgtgaactagtgtttcatgaaatcattttcctcttccatttatcatcctcctctggtacaatatattgggttgctttcttttagattttgttccagataggaaaacaaatatgactgtatacttattaacataaggtagttctgcatttttggattccaggatcctgtttgaaatcttccatgtgaggaaaaaattactaatatttttaaagacagggtggtttatttaaagagattattcagagaacttgtgccatatctcgtctgttttattgcatatgccatatgttaacttttattcaatattacattatgtagatatgtaatacaaagaaaatatttaggagaatggcaaaacacaaatggcaacataaatgtccatttgacttacctaacttcacaactttcaagttgaggatgtcatttattcttgaatttgtttttttactagatgctttcaattaatagccctatatttttgtgcaggcgaactgtataacaggataaaaaatgatttgtatgtattgaaaaggaggagaaattctcacagaacaccatatgagctttagaccaaaaggggaaacaaggtttaagtaactaaaatggccacttagtttgtgtttatttttttccctggaaatgtaagtagttggagtttaggctatggaaatattagtgcctttaatagatctctttccttgcaaagtttctttttagctcagcattgatctatcttatcaataggaaaataagttgacttggaactataaacaaaaacaacaccatatatttatgaacctcagtgaaccagcctagaaaaattgacttctgcaggtgctaaagcacctactaatacgcagcatgcacagcatttcaggttgtgaataccattttacaacgagtttgctgttaactctctttatccaatgcaaacttgaaattctgatgcggttttccagggtggtattttttcagagtattgaatttactatttagtaatttatagtatagctttttatattaaaatgtgatatttttaaaagagatatctggttcaattggtataatgacgtgattatgcaatatgctgatctacaccttgcgctcacattgtgccaaacttaaatgtgcaagtgtacgtgagaaaagcacatgtgaatgtgaattctttaattctttgcttattatgttaaaattagtcttcatagtccactgatgtgtatgcttgaataatgtctatttactttggaatttcaagatttccagcttcaatggtaatttataatttctcagatcaccttaagaaatattgagatactctcccacctgaaaataatctgttctttaacccacctgactatgggagtagccaggcaggtgcctcactggcttcttcagacgaggcttcctcaggtggatatatgactattaggggaaaagaggcttttgagacagcttattacctccttcccctttttgaactaagtacattgtctcagtcccagtatgaatttgtcccatttggggtatttttaaaataaaagatggctaacatggaatctggggcatagccttggcctttaattatggttgtaagcccaaataatggcagagaaacacagggctgtttttacaacagaaaactcaatataagttttatataagaatcctataaaatttgaaccagagctcctatttagttgttataatgtctcctaaagatcttaaatgcttctaaaagctaattattattccagagcaactttttccttttcccccttataaagtttttttttaaatccaaaatcttagatttctgtgccacagcaaaataaaatgatcaacaattaaagatctgtacttaaaatagtacaccatttttagtggagggagggtgcatgcctatatgatggtaagattcttttgaactctaaggacaattcctcatggaaaaaataaatttcagtgcatattataaaaatgatttgcactgtgttagcaaaataaggtgttttaggttgtattttaaagacaattctaaatcatttctctggaaagcaagaccttaaattcttctctttaatagaactgcttttatgcaaagagatggtcttaacatggactaaacagtacataacaataatgtttgttatgtaaatagtatatcacatttgcttagtagcacaattcaacagcaggctgaaagtcgtggctcctctgctcagattgagttttaagttacctaatttatgtaatcagaatctattctaggtggccgtcaacgtaaactgtgtttccctattatatccctctggagactgagaatcaaattaaatagtctttcttcaaagcagtactgtaacatgaatgtatttatctcagtcaacagaacttatatgcccactgtatgtggagcttatttcaatgctaatttggcttagttagcagacctagaatctgcccaggtgagacctagaacaaaaatagctggggtgaaatggataagagaggtagaggtatatgtcaaggcagagccctatgaggaaggaagagttttcaaagaatatgaggaacatagtgctgagagtgtggctgccttcagcaccgtacacctaatctagagaaaatatttcccatgtgggaggtcctgtctgcattcagtccacccttttctgcctgcttcttcctccaagtgcctcaacctctacatgctcactctcctccccttccctcagcccatcttggtctaagcagctttcacaatccaaaccaaacatcaccagccacccgctgataagtcaccagcatttactttcctgagttactttttctccattcattgagactatggattcatcccaactccttctaaatccctcaaccatccagctatattttggctaacctttgccctagacactctaccagatgttaatgcagtatcaagtgtaaattgtgtcaccctattctgttctacccttttccctgctgccgaaatatcttgctctcctctacctcatccccaaagagcctataaattcagagtatccaaccttttcatggattcactcactgttgttcagtaatacaacttccatattttaaataaatcataaaagatttttgccttctatcaaagtaggaaactttatatttatacatgatacagaaattgaactatttctatcgttcagaatttagcatataacaggattttaaagtgattgaattgccatcctaacttggatttgtattaggttatgaatgaatactgttgttagtccaagctatttgaatgtaaagttaaaattctccagcaatccagaatgacttgtaacccttcagtggaatgggaaatttctggtatgcaaatagggtggtgttccagacatttgttttattggtggtgtttgggccttgaaacacatttctaatagaatgacatatggcaaagggtatttagatggtcctatgggatcacagaagcccatatgatttaaaatatagataaaataacacaaaattgggtacataagggtttaaccaggctttcctgggttagactaagcctctaacctctgttcctatcctgttcttatgggaggaaaaaaaatgttccatgggatgaaaagaaaatgcattgactttgtagtctttattctcctagccgcacttcgggtatatccagaaggaagaggaaatgcaaagaggaagaagatgtaatagttcttctctccagctaggtgcacttgaggttgttcataaatgtaaaattatgtcaggtttctaacatgggacactgcacacagttgtctgacctgatgaaccatcccatttgaaagtatagattattattatttcttgtagtatttggttgttttccatctcattcatgaacaactcaacctgatagtagtatccaataaatgcctttcagggctcaggaatgaattgacatcctagttaagaaatgagacttaataatggagactgaatgaggcggtttgtattaaattatatgccatgaagtgttcattttagctttaacctaattatgactgtaccaccatgaagtacagaatgaaaaattatatatatgggggggaaacagaatgaatatctgattcttttgaatgcttgtggaaatctttgagatcgtgcagggcataccacaaaatagcctttagaacagatacccaattttacagttcataggacaacatcaaacattagtaagtctaaataagatgaatagaatttttgttatgtaaattttgctagaacagtctattttcttgcacccctcaagttaacctcttaaaaaaatgaatgtataatttctaccgaaagaatatcagagagaatctctctggcctatagtgttaaaatattgttcacaaatcctgattagttaagtgcatacattatgaaacttacagaataaaacttattatacatctctttcttaaattaatatctttacacattttcaactggctccccaagtctgataaggaaggattaaaagaaaaaagaaatgtattagttgggtggccaaggagtttcctttgtaatgttgagagacttccgctttctgaatttcgctggttctctaaggtaaaagagttaaatagtacccttgttcaccaaggaaagtgatccaaactatatatctagtgcagatatttcctttgcattatttagtcttctctggagagaaaatacagtttccccttcctctttctcttcacatttactcttttcaacccaaaataagagacatagaaagcaaaccacagccagtttggcatcttctcagtgctactagtataggcacatacacatacacagtctcagcaaggttataaagaaccctgtcaggtccacttgcaacatggccttgctacttggattagctcctttaagcctgaaaataactttcctggtcatggaagaactggacgcatcttttaacttatgaaatagaagttgaacttgaaaactctttttaaaaaatcctggttttgcaggacagctacataatgaatgtatatattaagactgtagctgaattgcacatgaaatcagattgccaacttcttgactttcaatgttagacatttatccttaagttgtgagcgatatatgtagcatgctgtgaaatgtctgttatagctctttaattcatcagtattaatacagaattatcatttgcgtttcttggtactttttattcaatgtaatcagaagctgtgatgttttgcctttgtagtcctgtgctttgttactgtaattttttttttttttttacgaagcacgtgactggactaatgtaaggcagatgacgtgatctttaagactgctatatatatcagtctcttactctataaggttttaaattagaataagcttttatcaaatagataattgatgcaatttaggattcacgcaagtttcagtgtcaaatggcggtcttatagtttcaattctgaaaatagcaaacttaataaacagccactttaaacttgttctggcaaaccagaccctgctgtagatatagtctaaggtagttaaccatataagccttttcaactcttaatgccctccacatgaatcagcagttaagaaggttctagaacccatgaaagcttttgtatgtattactaggttttgtttttcttatgtttgctgattttacagttctgactaaagctgacctaaatggatcagtttatgtgtaatattctagtgctttaatgactctttttttctttggagggagggtaacattatttggacagatgcagaaggaactgttagtgagtcaagacaaacacatctgaaataaaggaactgtgtattaacatgttaacaattcataactgcactttttatgacattttgaaaatctatttataggtacagaacaatgggttttgttaaactgtatcacatttatacttgcagaaatttatttcattgttattagtaggaattttattggttcaataaaattggcaaaactgaacaccaatcatttgcctactttgtttatactgga

SEQ ID NO: 180745 - DNA, 825 bp, Homo sapiens
  Payload ID: 15595
  Gene Symbol: SESN3
  Gene Name: sestrin 3
  ENST ID: ENST00000634898
  CDS Start-End: 575-825
agtcctgtggccacggccatggccgggtggggagctgggctccagtgagcacagagctccttgccagtaggcgatgcaagttatctctggggcccggaggacacgatgctggaatgaatccattcatctttaaatacttaactgcttctactacaatgagtactactgccagtttccactaataatagcagtactcatggctgccatttccagagtactcactagaactcattcttttggaaaagtgaaatagaaaaacatactactatgcaaatgaccactattacataaagctgtaaaaactagaccagaagtttacctcacatgtacaccattctaaggttgaagtagtcaaagatgaacaaggtactgaccgaccgccctacaaagaactgatgattcagtagagagagaggaggataaaagaatcagagtgtctcaacccttgacaagaggaccaagtgcctttattccagagaaggaagttgtccaagcaaacacagtggatgaacgtactaactttcttgtggaagaatactctacatccggtcgtctggacaacatcacacaggtcatgagtttacacactcagtacctggagtctttcttgcggagccagttttacatgttgcgcatggatggtccccttcctctaccatacaggcactatattgcaataatggctgcagctagacatcagtgttcttacttaataaacatgcatgtggatgaatttttaaagactggaggtattgctgagtggttgaatggtttggaatatgtgccacaaagactgaaaaatcttaatgaaattaataagctgct

SEQ ID NO: 180746 - DNA, 680 bp, Homo sapiens
  Payload ID: 15596
  Gene Symbol: SMYD1
  Gene Name: SET and MYND domain containing 1
  ENST ID: ENST00000438570
  CDS Start-End: 4-315
gagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctg

SEQ ID NO: 180747 - DNA, 4433 bp, Homo sapiens
  Payload ID: 15596
  Gene Symbol: SMYD1
  Gene Name: SET and MYND domain containing 1
  Uniprot ID: Q8NB12
  ENST ID: ENST00000419482
  CDS Start-End: 86-1558
gggatgctgaaggtgctgaaatagcaatgacaagagacttggctcagtgttaaataactgccgcgctggcctgacagtctctgagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaatcatgaggcagtgaaatccatgtttcatacccagatgagaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactatatggaggagggtgcagaggagggaatgtgtctggtgtgtgatgtgtgtgtgtgcagtgggggtatcacagagagtatgacatctgagttgagggtagcaggtgcctggagtctcaggtggctgctcacccatctgtgcaggtgtctctggggctgctggtctcacctgtggtctgcagtagacacaattggctgagcaggatatgtgatactgtgtggttggtgtggagttttgaagaaggggctgtgtttgggccacgtaggctctactcagagacctgaaaccacttcagaatggtgcatatgtcgaaagagctggctgggggccttgcccaaaccaactgaggtcttaaagtccagggaaaaaaagtctgggttccaactagaattctagaaatatttctagaacacacagagagggaataagtccctctatcacccttattaccaagccttgtggttccctgtgattttagataatgtctgatatttttctggctatttgcctagtaggatttaaaaaatattttcaaagtgaagctgagagagaatcttggaaacacacatacctgttgatcatgggccctgcagaattggcccttgggggctttatttggttacatgtgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttggggtgtcaccaagacttctacacaacccaggactaccattgacctcagagctgtaccccacatcttgaagtaaattgatcccaccaggtcccacgtttgttatctctgcctaaatgttagcttctccatcctcaccacatgatgacctgctgtgtccctctgagcactacccagtggctgaaaactctgcaaatgggccacacttttgcaaaatacttgtatctgacacttaggtcttgtttgaagaatttcctttctggaaggttttacaagaagactgatagtctttcaagcccccacatcacaggcttagggacggcactaactttctcccagggatctaactggctagttcaaattatcactcttttaccttcatataaaatgtctcccccaaacctttttcccttctttgtcattgttatctgctaagcccctggtcatttccccatattcgtagtctttttttccatcctatctttctaatatttgttgtctttaacaaactgtgttctgtgtctgtgctcctccttccctctcagaccactggaatgcaagtccttcttccctttggaatgtactctggatcccttcccctgctttgacccccagactttgctccatctattattgcttctccatcctggatccttgacatttgtcaccccactggccttctcaggtgcaatcagtaaaaatgctgagaactcttggatcttaatcttcatgactgagttttttttagttgtatagttatcatctgcctttcttcactttgcatttcttcttgaatccattgcagattgacttccactcccactccttcactaaaagggctcttaccaagatcaaatctaatgggtacattttagttcctatgtgatttggcctttcgatgtcaatcatcactcccagccattgattttggtgacccacttccctgtgatgatcttctgatctagtttctcaggttccttcgctggtcctttttctttccctgcccctgacatattgacatttcctggagttggttttgtccttgattcattctcatgtcattctgcacacagtctctgcatgaactcaggcagacccttcatttaatgaccaccttagggctgatgattctcaaatctgtattccccgatcttgcatttgagctccagccccactcatcctctcggatgttctgcaggcccagcaaactcatcatgtccaaagtgaaactttttctctttcctgtctcctctcctctgatctgttctttcttggaacaccacccaagaacgtcacctcctccatcagattgtgagctcctggagggcaggagctgtgtccttctattcatcttcctatccccagaaccttgcacagatcctggaatgtggtaggtgctcagtaaatgtgtgttgaataaatgaatgaatgaatgaacaaatgaatgaatttgcttacttcaaggcaaaagaaccatgaaactgtattttgagtttctatgttatagcagtcagcaaatcctattaaatactttgtgtttccaagcaaataa

SEQ ID NO: 180748 - DNA, 1816 bp, Homo sapiens
  Payload ID: 15596
  Gene Symbol: SMYD1
  Gene Name: SET and MYND domain containing 1
  ENST ID: ENST00000444564
  CDS Start-End: 41-1474
agtgttaaataactgccgcgctggcctgacagtctctgagatgacaatagggagaatggagaacgtggaggtcttcaccgctgagggcaaaggaaggggtctgaaggccaccaaggagttctgggctgcagatatcatctttgctgagcgggcttattccgcagtggtttttgacagccttgttaattttgtgtgccacacctgcttcaagaggcaggagaagctccatcgctgtgggcagtgcaagtttgcccattactgcgaccgcacctgccagaaggatgcttggctgaaccacaagaatgaatgttcggccatcaagagatatgggaaggtgcccaatgagaacatcaggctggcggcgcgcatcatgtggcgggtggagagagaaggcaccgggctcacggagggctgcctggtgtccgtggacgacttgcagaaccacgtggagcactttggggaggaggagcagaaggacctgcgggtggacgtggacacattcttgcagtactggccgccgcagagccagcagttcagcatgcagtacatctcgcacatcttcggagtgattaactgcaacggttttactctcagtgatcagagaggcctgcaggccgtgggcgtaggcatcttccccaacctgggcctggtgaaccatgactgttggcccaactgtactgtcatatttaacaatggcaaaattgagctccgggccctaggcaagatctcagaaggagaggagctgactgtgtcctatattgacttcctcaacgttagtgaagaacgcaagaggcagctgaagaagcagtactactttgactgcacatgtgaacactgccagaaaaaactgaaggatgacctcttcctgggggtgaaagacaaccccaagccctctcaggaagtggtgaaggagatgatacaattctccaaggatacattggaaaagatagacaaggctcgttccgagggtttgtatcatgaggttgtgaaattatgccgggagtgcctggagaagcaggagccagtgtttgctgacaccaacatctacatgctgcggatgctgagcattgtttcggaggtcctttcctacctccaggcctttgaggaggcctcgttctatgccaggaggatggtggacggctatatgaagctctaccaccccaacaatgcccaactgggcatggccgtgatgcgggcagggctgaccaactggcatgctggtaacattgaggtggggcacgggatgatctgcaaagcctatgccattctcctggtgacacacggaccctcccaccccatcactaaggacttagaggccatgcgggtgcagacggagatggagctacgcatgttccgccagaacgaattcatgtactacaagatgcgcgaggctgccctgaacaaccagcccatgcaggtcatggccgagcccagcaatgagccatccccagctctgttccacaagaagcaatgaggactgcccagtggaggaggggcgatgtggctggggagctagggagagactctggaggtggtgggtctctcgggagacccctaatgaggaagttgaggtaatgcttaacattgttgctgtgagaatttactgccctatgtttcccagagccattttggctcaattcaagtctattcaattcaagttaactctagcccagcccagatcaactcctcctacaaatattattggatgataggccctagaacccaataaaggagctccaaatgtcgttgggtggggaagcaaaatgtagagaaacatttaaagcacactgtaataataaatgcaattataaactat

SEQ ID NO: 180749 - DNA, 1671 bp, Homo sapiens
  Payload ID: 15597
  Gene Symbol: SMYD2
  Gene Name: SET and MYND domain containing 2
  Uniprot ID: Q9NRG4
  ENST ID: ENST00000366957
  CDS Start-End: 23-1324
gcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcggattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagta

SEQ ID NO: 180750 - DNA, 702 bp, Homo sapiens
  Payload ID: 15597
  Gene Symbol: SMYD2
  Gene Name: SET and MYND domain containing 2
  ENST ID: ENST00000416415
  CDS Start-End: 1-296
ctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagcctaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagta

SEQ ID NO: 180751 - DNA, 732 bp, Homo sapiens
  Payload ID: 15598
  Gene Symbol: SMYD3
  Gene Name: SET and MYND domain containing 3
  ENST ID: ENST00000391836
  CDS Start-End: 290-732
ggcggaggccgtccctgaggaagtaggagaagaccactagggctgtgtctaagtcacagcgaaaagttgttccgtgagacctcttgcataatgactctaaggggcttcagagacattctcctgcgaggtaactgtgcctgtgatgtggggagagtgtgagactgggaagcagaagaccggaatgtgatacagcctttcccacgacttggctgaggaactgctgttgtgaaccttttgccctggtgggattattgtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgc

SEQ ID NO: 180752 - DNA, 1209 bp, Homo sapiens
  Payload ID: 15598
  Gene Symbol: SMYD3
  Gene Name: SET and MYND domain containing 3
  ENST ID: ENST00000403792
  CDS Start-End: 96-644
gtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaacccataggcatgaaatgattgcttcttgatatttaccctgggatagggatgacagaaacaccccctcactgctatggatctgctgtcctcgctttctcacattgtgtgtttgcatttgttttaatgttgatcacaatttaataacaagtaaaactttacttttgacaattttgccacttattttgtaatttgtaagcacacgtttgaagatatatttatgccattaatattttaaggcatgttttaaaatttactgttttctgaaaaattaaatgtaattggtttgattgctggagatttattccagtttttctcaaatgtatttttattctgtatggtacatttttatgattttctgattaatgtcatcttagcattatattctggttatctataatttaaaattgatttcaaaatttactgatttcttacagtgcatctgaaaactttctcatctatttcatatgcttctgaaaattataacctgtagtagtatcgtgtgccgtgcccaaggctgttttcatgttcaacactataaacacgaacacctactgaaagataaaaatataccttatgatgatta

SEQ ID NO: 180753 - DNA, 566 bp, Homo sapiens
  Payload ID: 15598
  Gene Symbol: SMYD3
  Gene Name: SET and MYND domain containing 3
  ENST ID: ENST00000455277
  CDS Start-End: 345-566
agaggagaaagaatgtgaatgctcattgctggtcatttttttttcctgtgctatgccatcttaattgttcatagctcttctcttttaagaaagcttatgtgagagccacaattgtatcagagaacattattacataattatacagccttccctttcccttaaatggtcctttaaggctttacatctgcaatagagatagcttagtgaatattcttccaaataagtttttttagtttcatttttagattagccttttgtatttgcgtaaaacagtgcttttggtaaatgttgtgtatttaaggggaagaacaggatacttctgggggctgaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatatt

SEQ ID NO: 180754 - DNA, 562 bp, Homo sapiens
  Payload ID: 15598
  Gene Symbol: SMYD3
  Gene Name: SET and MYND domain containing 3
  ENST ID: ENST00000453676
  CDS Start-End: 169-562
ggtcctgcctcttccccgccatcttctgtcagacaaaaggacttagtttttctatcagtgtctcacatggaaggttcaagaggaggctcatcagtgtgaaaatccaaatcttaagggactgtacataatggagtaaacagaacatacgggtgtccgaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgc

SEQ ID NO: 180755 - DNA, 1548 bp, Homo sapiens
  Payload ID: 15598
  Gene Symbol: SMYD3
  Gene Name: SET and MYND domain containing 3
  Uniprot ID: Q9H7B4
  ENST ID: ENST00000490107
  CDS Start-End: 41-1327
ggacgcgggtagccgtctgaggtgccggagctgcgggaggatggagccgctgaaggtggaaaagttcgcaaccgccaagaggggaaacgggctgcgcgccgtgaccccgctgcgccccggagagctactcttccgctcggatcccttggcgtacacggtgtgcaaggggagtcgtggcgtcgtctgcgaccgctgccttctcgggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgcca

SEQ ID NO: 180756 - DNA, 1458 bp, Homo sapiens
  Payload ID: 15598
  Gene Symbol: SMYD3
  Gene Name: SET and MYND domain containing 3
  Uniprot ID: Q9H7B4
  ENST ID: ENST00000630181
  CDS Start-End: 128-1237
gtggatttgagagatacctcccctccttctgctcagctgccttgcagtaattaaactctttctctgctgcaacacccctactgttctccgtgtattggcttttctgggcagcaggaaggaaaagctgatgcgatgctctcagtgccgcgtcgccaaatactgtagtgctaagtgtcagaaaaaagcttggccagaccacaagcgggaatgcaaatgccttaaaagctgcaaacccagatatcctccagactccgttcgacttcttggcagagttgtcttcaaacttatggatggagcaccttcagaatcagagaagctttactcattttatgatctggagtcaaatattaacaaactgactgaagataagaaagagggcctcaggcaactcgtaatgacatttcaacatttcatgagagaagaaatacaggatgcctctcagctgccacctgcctttgacctttttgaagcctttgcaaaagtgatctgcaactctttcaccatctgtaatgcggagatgcaggaagttggtgttggcctatatcccagtatctctttgctcaatcacagctgtgaccccaactgttcgattgtgttcaatgggccccacctcttactgcgagcagtccgagacatcgaggtgggagaggagctcaccatctgctacctggatatgctgatgaccagtgaggagcgccggaagcagctgagggaccagtactgctttgaatgtgactgtttccgttgccaaacccaggacaaggatgctgatatgctaactggtgatgagcaagtatggaaggaagttcaagaatccctgaaaaaaattgaagaactgaaggcacactggaagtgggagcaggttctggccatgtgccaggcaatcataagcagcaattctgaacggcttcccgatatcaacatctaccagctgaaggtgctcgactgcgccatggatgcctgcatcaacctcggcctgttggaggaagccttgttctatggtactcggaccatggagccatacaggatttttttcccaggaagccatcccgtcagaggggttcaagtgatgaaagttggcaaactgcagctacatcaaggcatgtttccccaagcaatgaagaatctgagactggcttttgatattatgagagtgacacatggcagagaacacagcctgattgaagatttgattctacttttagaagaatgcgacgccaacatcagagcatcctaagggaacgcagtcagagggaaatacggcgtgtgtctttgttgaatgccttattgaggtcacacactctatgctttgttagctgtgtgaacctctcctattggaaattctgttccgtgtttgtgtaggtaaataaaggcagacatggtttgcaaaccacaagaatcattagttgtagagaagcacgattataataaattcaaaacatttggttgaggatgcca

SEQ ID NO: 180757 - DNA, 4384 bp, Homo sapiens
  Payload ID: 15599
  Gene Symbol: SMYD4
  Gene Name: SET and MYND domain containing 4
  Uniprot ID: Q8IYR2
  ENST ID: ENST00000305513
  CDS Start-End: 169-2583
ctggcgcgggacgccggacgcggtgcggggcggagcggggcgccaaggggcgcgccaggagctgcgcgggcgctgggagggagaccagggcgcagttccgggcgcgtctgagcggttctcgaggcgttctcgcctcggtctctggcgagtgcacggatcaaaagcagcatggatctgcctgtggatgaatggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagcggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctacgtggtggaggttcgccacgggccgtccagtgttgaaatgggccatgagctcttcaaattggcccagatctttttcaacgggtttgcagtacccgaagccctgagcacaatacagaaagctgaggaggttctgtcgctgcactgtggcccatgggacgatgaaatccaggagctccagaagatgaaatcctgtttgttggacttaccacccacccctgtagggcctgcattgtagggttccaggaggattttgacccacagaaaaggagcccatggaacacaagttaaagaggttttgctggccaggtatggtggctcacgcctgtaatcccagcactttgggaggctaaggtgggcggatcacctgatgtcaggagttcaagaccagcctggccaacatggtgaaaccccatctttactaaaaatacaaaaaactagccaggcgtggtggtgggcacctgtaatcccagctacttgggaggctgaggcaggagaatctcttgaacccaggaggcggaggttgcagtgagccgagatcgctccactgcactccagcccaggtgacagtgtgagactccatctcaaaaaaaaaaataagaggccgggtgcggtggctcaagcctgtaatcccagcactttgggaggccgaggcaggcagatcacgaggtcaggagatccagaccatcctggctaacacggtgaaaccccgtctctactaaaaatacaaaaaaattagtcgggcgtggtggcggacgcctgtattcacagctactcgggaggttgaggcaggagaatggggtgaacccgggaggaagagcttgcagtgagccgagatcgcgccactgcactccagcctgggtgacagagccagactccatctcaaagaaaaaaaaaaaatattaagaggttctgctgccagatgtgggttctgtgggtcgggtgtgggttctgtgggtcgggtgtgggttctgcagaccaggtgcggattctgtgtaggttctgcaggcccagtgtagaggctcacacctgtaatcccagtactttgagacgctgaggtgggaggatcacttgagcccaggagttcaaaaccagcctgggcaatatagtgagaccgtatcactacaaaaaagtttttttagttcaccgagcatggtggcacatgcctgtagtcccacctactcgagaagctgagatagggtcacctgagcctggtaggctgaggctgcagtgagccaagatcgcactactgcactccagcctgggtgacagagtaagaccctgtctcaacaaaaaaataacaggttctgttgctgctgagctttcgtcaggaagataagactttcccaacagtccgaagcctaggatatgagggctgaggaggactcaaaccgttgcagtcagagagacacctattttggtgaatattttttgaaatagttaagtggcctccagtacaaactcccagttcccagaaaagacttaaaactagtatctggagattccaagtcctttaaaaggattttagctgatctgcaggcatctggatgttagcctggggttttggctggattccacctcgctcagtgatgatagtctgtttccctggaacattcctgtggttttagtagtaatgagatgtgtgcaccactccagtgggaactgaagctcttagtagttacattgtaattaaaaaagaattataaaacaagaaatcagcaagcctgcttacctccagagacacaccgttccacttacagtatctagcttcctcgactcctttgttaaaatcgtggagtatgaaccgtgaccagagaagtaaatatggagccgttttattgagcagtttcctccagggatgacggctgtcagtgtgtttcctgccagttttccagtccttactctctgcccttcattctgtactcttggcagagtcagtaaccaaccactaataaaatcaaagttgtagtaaagactttataacacatatgcctccttctgagttgttggttttgttttgttttgttttgttttgtttt

SEQ ID NO: 180758 - DNA, 515 bp, Homo sapiens
  Payload ID: 15599
  Gene Symbol: SMYD4
  Gene Name: SET and MYND domain containing 4
  ENST ID: ENST00000576633
  CDS Start-End: 98-316
gctgggagggagaccagggcgcagttccgggcgcgtctgagcggttctcgaggcgttctcgcctcggtctctggcgagtgcacggatcaaaagcagcatggatctgcctgtggatgaatggaaatcatatctgcttcaaaagtgggcttcactcccgacgtctgttcaggtcacaatttctacagcagagaccttgagggatatctttcttcactcctcttcacttcttcagttggagtgtgatggtgcgatctcagctcactgcaaccttcacctcccaggctcaagcgattctcgtgcctcggcctcccaatagctgagactacaagtgcttgccaccacgcccggctaatttttgtattttttgtggaggtgggttccactatgttgcccaggctggtcgcaaactcgtggaccaggtgacctgcccacctcggcctcccagagtgctgggattacagacctgaggatgagctgtttctaaaaagactttctaaaggttacttggtgggaaa

SEQ ID NO: 180759 - DNA, 793 bp, Homo sapiens
  Payload ID: 15599
  Gene Symbol: SMYD4
  Gene Name: SET and MYND domain containing 4
  ENST ID: ENST00000570368
  CDS Start-End: 124-793
agggtgttggaatcacagctgggaaatcagggacgccgtcccggaggaggtgccatttgagccgagtcgaagaacgtgtgggaattttccaggtggactccataagccaggatcaaaagcagcatggatctgcctgtggatgaatggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccagccctagcagatgtcctccctcagactctgcagagaaacctccatcgtctgaaaatgaagatgcaagaaaaggacagtctcacagaaagcttcccagcagctctggccaaaacccttgaggatgcagcgctgagggagg

SEQ ID NO: 180760 - DNA, 3016 bp, Homo sapiens
  Payload ID: 15599
  Gene Symbol: SMYD4
  Gene Name: SET and MYND domain containing 4
  ENST ID: ENST00000491788
  CDS Start-End: 1-1677
aagatgcaagaaaaggacagtctcacagaaagcttcccagcagctctggccaaaacccttgaggatgcagcgctgagggaggagaatgaacaactttccaatgcctcatcatccatcggcttatgcgtagatcctttaaaaggtcgctgtctcgttgccacaaaagatattctcccaggagagctcctggtgcaggaggatgcttttgtgagtgttctcaacccaggagaactgccaccaccgcatcacggcctagacagcaaatgggacaccagagtcaccaatggggacctctattgtcaccgatgtttgaagcacactttggccacagttccgtgtgacggatgcagttatgccaagtattgcagccaggagtgtttgcagcaggcctgggagctctaccacaggacagaatgtcctctgggagggctgcttctcacactgggtgtcttttgccacattgccctgaggttgactcttttggtgggatttgaggatgttcgcaaaatcataacgaagctttgtgataagattagtaacaaggacatctgtttacctgaaagcaacaatcaggtcaagacacttaattatggcctaggggagagtgagaaaaatggcaacatcgttgagaccccaattcctggatgcgatattaatgggaagtatgaaaataattataatgctgtcttcaaccttttgccccacactgaaaaccatagcccagagcacaaattcctctgtgctctctgtgtttctgcactgtgcagacagctagaagcagccagtttacaggccatcccaactgagaggattgtgaactcctctcagcttaaagcagcagtgacacctgaattgtgtcctgacgtgactatttggggagtggcgatgctgagacacatgttacagcttcagtgtaacgctcaggcgatgaccaccatacaacacacaggacctaaagggagcatcgttaccgacagcaggcaggtgcgccttgccacaggcatcttccctgttatcagcctcctgaaccactcctgtagccccaacaccagcgtgtccttcattagcactgtcgccaccatccgggcgtcacagcggattagaaaggggcaagagattctccactgctatgggcctcacaagagccggatgggggttgccgaaaggcagcagaagctgaggtctcagtatttctttgactgcgcctgtccagcttgtcaaactgaggcacacaggatggctgcagggcccaggtgggaagcattctgttgcaacagttgcggagcgcccatgcagggagatgacgtgctgcgctgtggcagcagatcttgtgcagaatccgccgtcagcagggaccacctggtctctcggttacaggacctacagcagcaggtcagagtggcccagaagcttctcagagatggtgaactagagcgagctgttcagcggctgtcggggtgccagcgtgacgccgagagcttcctgtgggcagagcacgccgtggtgggagagatcgcggatggcctggcccgggcctgtgctgccttaggagactggcaaaagtcagccacccatctacagaggagtctctacgtggtggaggttcgccacgggccgtccagtgttgaaatgggccatgagctcttcaaattggcccagatctttttcaacgggtgagtccctttcccacttcacagggcacacactgttcctttcctaggctcttctgggtattactttttttctatggtgtttttaaaagcatgttgaaacttctttatttcctctttaggagagatctttgccttctgttttgctaacaaacataacgctttagaatttcctcctgggaggcggagcttgcagtgagccaagatcgcgccactgcactgtagcctgggcgacagagcgagactccatctcaaaaaaaaaaaaaaaaagaatttcctcctgggagatatggggaaagcttttagatctcaagtgagtttcccagagagaacttggccaggcagccccacccaccctccagtatagctctccttctggttgttctctggttcgtcacagcccctttggctgtctcattcccagcactctcagctccaggctctctgccttctccctactctgcatcctcttccttttaaagcgtttgcttgaaccagggctgattttacccccagacaacatgtggcattgcctggagacttttttttttttttttttgagaaggggtcttgctgtcttgcccaggctggagtacagtggctcggtcacagctcactgcttcctgcaactcctgggctcaagcgatctctggagacattttggattgtcatgacttggaaggggggtgctgctggcatctattcgaaagaggccagaggtgctgctaagcatcctcccgggtacaagacagtgccccccccaccaaccccagcaaagaaggagccagcaacagtgtcaatagtgtcagggtcgagaaaccctgcttttttgctgctgttgtttgttttttgttttaaatcccctgttctactttgaaggttaaaaggaaagaacagcacgctgatgagctgatgccaaatccacttttgctactgagaccatttagggcccaatttcaggatttccgggtggaacctccaaccctggtaaagctgcccttggtgtatgtggctatgagaaagtgcttaaagcttcaacctaaggctgtgctgagtgggcctggtacccaagacacagagacattctgtttggtcagagagagagaaaagggctgcagagttaggtcagaggtcagccctaagatggtcaccctaaaatgaaaactgctatgtaaacctgtggtaaataccagatgaaaactttgaggccgggtgtggtagctcacgcctgtaatccagctgcccaggaggttgaggcaggagaatcacttgaacccgggaggcggaggttgcagtgagccgaggtcgcacaaatacctgggcgacaagagtgaaactcttgtctc

SEQ ID NO: 180761 - DNA, 586 bp, Homo sapiens
  Payload ID: 15599
  Gene Symbol: SMYD4
  Gene Name: SET and MYND domain containing 4
  ENST ID: ENST00000571854
  CDS Start-End: 55-586
gaagcaagcagggcttaaacgcaaacgctgctgagaactcagatcaaaagcagcatggatctgcctgtggatgaatggaaatcatatctgcttcaaaagtgggcttcactcccgacgtctgttcaggtcacaatttctacagcagagaccttgagggatatctttcttcactcctcttcacttcttcaacctgaggatgagctgtttctaaaaagactttctaaaggttacttggtgggaaaggactcggacgctcctcttttctacagagaagaaggaaacaaaaaatttcaggagaaagattacacaggagctgcagtgctgtactctaagggagtgtcacattcaaggcctaacactgaggacatgtcactgtgtcatgctaaccgctcggcagccctcttccacctgggtcagtatgagacgtgtcttaaagacattaacagagcacagacacatgggtatccagaaaggttgcaacccaagattatgttacgtaaagcagaatgtctggtggccctggggagactgcaggaggcaagccagaccatcagtgatcttgaaaggaacttcacagccacaccag

SEQ ID NO: 180762 - DNA, 6045 bp, Homo sapiens
  Payload ID: 15600
  Gene Symbol: SBF1
  Gene Name: SET binding factor 1
  ENST ID: ENST00000348911
  CDS Start-End: 103-5709
gtgcgcggtccagggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacagcaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgcca

SEQ ID NO: 180763 - DNA, 8008 bp, Homo sapiens
  Payload ID: 15600
  Gene Symbol: SBF1
  Gene Name: SET binding factor 1
  Uniprot ID: O95248
  ENST ID: ENST00000380817
  CDS Start-End: 185-5866
ctggctgggaagatggcggcgggaacctgggccgccgccgccgccgccgccgccgccgcggagcgaaccaggggtgtccggggtgcgcggtccagggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagtggggaaggccagggccagattctgcagcgcttcccagagaaggactgggaggacaacccattcccccagggcatcgagctgttttgccagcccagcgggtggcagctgtgtcccgagaggaatccaccgaccttctttgttgctgtcctcaccgacatcaactccgagcgccactactgcgcctgcttgaccttctgggagccagcggagccttcacaggaaacgacgcgcgtggaggatgccacagagagggaggaagagggggatgagggaggccagacccacctgtctcccacagcacctgccccatctgcccagctgtttgcaccgaagacgctggtactggtgtcgcgactcgaccacacggaggtgttcaggaacagccttggcctcatctatgccatccacgtggagggcctgaatgtgtgcctggagaacgtgattgggaacctgctgacgtgcactgtgcccctggctgggggctcgcagaggacgatctctttgggggctggtgaccggcaggtcatccagactccactggccgactcgctgcccgtcagccgctgcagcgtggccctgctcttccgccagctaggcatcaccaacgtgctgtctttgttctgtgccgccctcacggagcacaaggttctcttcctgtcccggagctaccagcggctcgccgatgcctgtaggggcctcctggcactgctgtttcctctcagatacagcttcacctatgtgcccatcctgccggctcagctgctggaggtcctcagcacacccacgcccttcatcattggggtcaacgcggccttccaggcagagacccaggagctgctcgatgtgattgttgctgatctggatggagggacggtcaccattcctgagtgtgtgcacattccacccttgccagagccactgcagagtcagacgcacagtgtgctgagcatggtcctggacccggagctggagttggctgacctcgccttccctccgcccacgacatccacctcctccctgaagatgcaggacaaggagctgcgcgcggtcttcctgcggctgttcgctcagctgctgcagggctatcgctggtgcctgcacgtcgtgcgcatccacccggagcctgtcatccgcttccataaggcagccttcctgggccagcgtgggctggtagaggacgatttcctgatgaaggtgctggagggcatggcctttgctggctttgtgtcagagcgtggggtcccataccgccctacggacctgttcgatgagctggtggcccacgaggtggcaaggatgcgggcggatgagaaccacccccagcgtgtcctgcgtcacgtccaggaactggcagagcagctctacaagaacgagaacccgtacccagccgtggcgatgcacaaggtacagaggcccggtgagagcagccacctgcgacgggtgccccgacccttcccccggctggatgagggcaccgtgcagtggatcgtggaccaggctgcagccaagatgcagggtgcacccccagctgtgaaggccgagaggaggaccaccgtgccctcagggccccccatgactgccatactggagcggtgcagtgggctgcatgtcaacagcgcccggcggctggaggttgtgcgcaactgcatctcctacgtgtttgaggggaaaatgcttgaggccaagaagctgctcccagccgtgttgagggccctgaaggggcgagctgcccgccgctgcctcgcccaggagctgcacctgcatgtgcagcagaaccgtgcggtcctggaccaccagcagtttgactttgtcgtccgtatgatgaactgctgcctgcaggactgcacttctctggacgagcatggcattgcggcggctctgctgcctctggtcacagccttctgccggaagctgagcccgggggtgacgcagtttgcatacagctgtgtgcaggagcacgtggtgtggagcacgccacagttctgggaggccatgttctatggggatgtgcagactcacatccgggccctctacctggagcccacggaggacctggcccccgcccaggaggttggggaggcaccttcccaggaggacgagcgctctgccctagacgtggcttctgagcagcggcgcttgtggccaactctgagtcgtgagaagcagcaggagctggtgcagaaggaggagagcacggtgttcagccaggccatccactatgccaaccgcatgagctacctcctcctgcccctggacagcagcaagagccgcctacttcgggagcgtgccgggctgggcgacctggagagcgccagcaacagcctggtcaccaacagcatggctggcagtgtggccgagagctatgacacggagagcggcttcgaggatgcagagacctgcgacgtagctggggctgtggtccgcttcatcaaccgctttgtggacaaggtctgcacggagagtggggtcaccagcgaccacctcaaggggctgcatgtcatggtgccagacattgtccagatgcacatcgagaccctggaggccgtgcagcgggagagccggaggctgccgcccatccagaagcccaagctgctgcggccgcgcctgctgccgggtgaggagtgtgtgctggacggcctgcgcgtctacctgctgccggatgggcgtgaggagggcgcggggggcagtgctgggggaccagcattgctcccagctgagggcgccgtcttcctcaccacgtaccgggtcatcttcacggggatgcccacggaccccctggttggggagcaggtggtggtccgctccttcccggtggctgcgctgaccaaggagaagcgcatcagcgtccagacccctgtggaccagctcctgcaggacgggctccagctgcgctcctgcacattccagctgctgaaaatggcctttgacgaggaggtggggtctgacagcgccgagctcttccgtaagcagctgcataagctgcggtacccgccggacatcagggccacctttgcgttcaccttgggctctgcccacacacctggccggccaccgcgagtcaccaaggacaagggtccttccctcagaaccctgtcccggaacctggtcaagaacgccaagaagaccatcgggcggcagcatgtcactcgcaagaagtacaacccccccagctgggagcaccggggccagccgccccctgaggaccaggaggacgagatctcagtgtcggaggagctggagcccagcacgctgaccccgtcctcagccctgaagccctccgaccgcatgaccatgagcagcctggtggaaagggcttgctgtcgcgactaccagcgcctcggtctgggcaccctgagcagcagcctgagccgggccaagtctgagcccttccgcatttctccggtcaaccgcatgtatgccatctgccgcagctacccagggctgctgatcgtgccccagagtgtccaggacaacgccctgcagcgcgtgtcccgctgctaccgccagaaccgcttccccgtggtctgctggcgcagcgggcggtccaaggcggtgctgctgcgctctggaggcctgcatggcaaaggtgtcgtcggcctcttcaaggcccagaacgcaccttctccaggccagtcccaggcggactcgagtagcctggagcaggagaagtacctgcaggctgtggtcagctccatgccccgctacgccgacgcgtcgggacgcaacacgcttagcggcttctcctcagcccacatgggcagtcacgttcccagccccagagccagggtcaccacgctgtccaaccccatggcggcctcggcctccagacggaccgcaccccgaggtaagtggggcagtgtccggaccagtggacgcagcagtggccttggcaccgatgtgggctcccggctagctggcagagacgcgctggccccaccccaggccaacgggggccctcccgacccgggcttcctgcgtccgcagcgagcagccctctatatccttggggacaaagcccagctcaagggtgtgcggtcagaccccctgcagcagtgggagctggtgcccattgaggtattcgaggcacggcaggtgaaggctagcttcaagaagctgctgaaagcatgtgtcccaggctgccccgctgctgagcccagcccagcctccttcctgcgctcactggaggactcagagtggctgatccagatccacaagctgctgcaggtgtctgtgctggtggtggagctcctggattcaggctcctccgtgctggtgggcctggaggatggctgggacatcaccacccaggtggtatccttggtgcagctgctctcagaccccttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtcctgcggccctacagcaacgtgtccaacctgaaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaacgccacgctcctgtgcctgccttccccactccccggctgcctgctctcggcctacccagagggtcccatctgcccctatccaggcccacctggcgggaggttggcatctttctcgtgagcctctcctggtgcctgggtccacccagctcggcctgcatgtccctgggagtgactttgctctgggggcggatcgagcaggaggcttcactggggacttgcttgattccctccacgcctcagggctggtctaggggccggcacggctggagaggaagcccccatccctacccaggggatgcagaagctgacctcacagaggcttgggggtgaaagggtgggtggtcatttgaccccagaaggctgttgcaggtccagaggacacttgaggtggacgtcagtttctggctagacccgagctgaagggatggaggccggaggcgggggggggggggggacagtgggctcccaggggaatgcaggttgaccacatctggctcctgccaggcaacgagcagcatctggcagagtaaggggccaacgcccatgggggatggaccctctcagttcttgggaattctgccccaaaagtcctttccctggggtctcagagggcccccgtccttcccttcttggtgtcactgtggcccctcactgctcttttcctattcaaacctgagtcccaccaggcccagggcttcacctgctgagctgttgtgtccttgcctgtgacgaggcctggccaggggtgcaggagcagaaggtggggagggttatagacgctgcaaaggccaagagaacatctgagagtggcagctggtgacctggccagaggggctggtgaggggcagagaacctggctagaggctgggtccctcaggtggtcctctcaggtgggaggcgagcagcaggtgtgggtgaggggaaggttctgatgacagctgcagaggcagggcccagtgctggcaggtggggggccaagaccctcccctggtgggacgttgaagccaaggatggccttggaccctgtcaggcccagcatggtcccgccacctcccccaccccacaggtggtgttgggacacctgggcgagatgtgagggtgggctcacttgagccactgaaaccagccaggtcttccctcaggccggacagatggcgcctgaccgaagttcctggcacctggaaaacccacaggtcagagtaaggggagaaaggaccctgccctccctgttccacgtctgtggggggagaggacaaatgccaggcacagggtaggcggcgagaacaaggcactcaatgtgtagctggggcagagactcggcctctggggagctgagcgggttccctccacccccaaccgtggtggaaagacaagctcgctggggcggggtgggggtctggtctccacctgcccctcccactcagccactgaggacaaggtggggcccaggcttctgggagggggagctggcacaaaaggaagtcctggggttgatgtgtttgagcgttaggcgaagtggttccccccatcccccaaacggaaaaatgtcagtatttgctaagctgtagagacctgatgccgtgatgtggcctgttccgcctccacccattacacggggataacgctggggggtggcgggcccacaaaagaggtgctggaggagactctcccacccctggccgggccggggctttggggccggaaggttcacagtacgcggtttgtccgaacgtcacggcttttattgggagttgggggtttggggtgccctgtcaggtgatcagaacattaaaaatggactcaacgtaaaa

SEQ ID NO: 180764 - DNA, 1578 bp, Homo sapiens
  Payload ID: 15600
  Gene Symbol: SBF1
  Gene Name: SET binding factor 1
  ENST ID: ENST00000418590
  CDS Start-End: 1-1246
cttctaccgcacgctggagggctttcgcctgctggtggagaaggagtggctgtccttcggccatcgcttcagccaccgtggagctcacaccctggccgggcagagcagcggcttcacacccgtcttcctgcagttcctggactgcgtacaccaggtccacctgcagttccccatggagtttgagttcagccagttctacctcaagttcctcggctaccaccatgtgtcccgccgtttccggaccttcctgctcgactctgactatgagcgcattgagctggggctgctgtatgaggagaagggggaacgcaggggccaggtgccgtgcaggtctgtgtgggagtatgtggaccggctgagcaagaggacgcctgtgttccacaattacatgtatgcgcccgaggacgcagaggtgtgggacttctacactgaggagacgctggccgagggccctccctatgactgggaactggcccaggggccccctgaacccccagaggaagaacggtctgatggaggcgctccccagagcaggcgccgcgtggtgtggccctgttacgacagctgcccgcgggcccagcctgacgccatctcacgcctgctggaggagctgcagaggctggagacagagttgggccaacccgctgagcgctggaaggacacctgggaccgggtgaaggctgcacagcgcctcgagggccggccagacggccgtggcacccctagctccctccttgtgtccaccgcaccccaccaccgtcgctcgctgggtgtgtacctgcaggaggggcccgtgggctccaccctgagcctcagcctggacagcgaccagagtagtggctcaaccacatccggctcccgtcaggctgcccgccgcagcaccagcaccctgtacagccagttccagacagcagagagtgagaacaggtcctacgagggcactctgtacaagaagggggccttcatgaagccttggaaggcccgctggttcgtgctggacaagaccaagcaccagctgcgctactacgaccaccgtgtggacacagagtgcaagggtgtcatcgacttggcggaggtggaggctgtggcacctggcacgcccactatgggtgcccctaagactgtggacgagaaggccttctttgacgtgaagacaacgcgtcgcgtttacaacttctgtgcccaggacgtgccctcggcccagcagtgggtggaccggatccagagctgcctgtcggacgcctgagcctcccagccctgcccggctgctctgcttccggtcgttaccgaccactaggggtgggcagggccgccccggccatgtttacagccccggccctcgacagtattgaggccccgagcccccagcacttgtgtgtacagcccccgtccccgccccgccccgcccggccggccctaacttattttggcgtcacagctgagcaccgtgccgggaggtggccaaggtacagcccgcaatgggcctgtaaatagtccggccccgtcagcgtgtgctggtccagccagcggctgcaggcgagtttctagaaccagagtctatataaagagagaactaac

SEQ ID NO: 180765 - DNA, 7439 bp, Homo sapiens
  Payload ID: 15601
  Gene Symbol: SBF2
  Gene Name: SET binding factor 2
  Uniprot ID: Q86WG5
  ENST ID: ENST00000256190
  CDS Start-End: 139-5688
ggttgtcaaacatggctgaagcgctgccgctgccgctactgccgctgcagggaaaatgctgagccctcccgggccgggtgggcggcggcggcgagggcggcgacggggacccgcttcccgagcgcggcggcggcggccatggcccggctggctgactacttcatcgtggtaggctatgaccacgagaagccaggatcaggagaaggtctggggaaaataatccagagatttccacagaaggactgggatgatacaccttttccacagggaattgagttgttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggaattcaaaatgtcctcagcctcttttgtgcagtcctcacagaaaataaggttctcttccattctgcaagtttccagagacttagtgatgcttgtagagccctggaatctttaatgtttcctcttaaatatagttatccttatatccctattctcccggctcagctactggaagttctaagttccccaacgcctttcattattggagtacattctgtctttaaaactgatgtccatgaacttttagatgtaatcatagcagatttggatggaggcactattaaaattcccgaatgtattcacctctcttccctcccagaaccacttctacatcagactcaatcagctctttctttgattttacacccagatttggaagtagcagatcatgcttttcctcctccacgaacagctttatcccactcaaaaatgctggataaagaggtgcgagccgttttccttagattatttgcacaactcttccaaggatatagatcctgcctgcaacttataagaattcatgcagagccagtaatacatttccacaagacagcattcttggggcagcgtggtttggtcgagaatgatttcctcactaaagtactcagtggaatggcatttgcaggttttgtttcagaaagaggtcctccttatagatcttgtgatctctttgatgagttggtagcctttgaagtagagagaattaaagttgaagaaaataacccagtgaagatgataaagcatgtcagggaacttgctgagcaactattcaaaaatgagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttgtttcgataatggacaaggtgacgacagttttcaacagtgcacaaagactagaagttgtcagaaactgtatctcattcatatttgaaaataaaattttggaaactgaaaagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggattgttcaagtttagaagaatacaacattgccgcagcattactccctttgaccagtgctttctataggaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggataagcttcctgatgaccattatcaggagaagacagcaatggacctggcagctgagcaactacgcctttggcctaccctgagcaagtcaactcagcaagagctagtgcaacatgaggaaagcactgtctttagtcaggccattcactttgcaaacctcatggtgaacctgctagttccactcgacacaagtaaaaacaagctcctaagaacatcagcgccaggtgactgggagagcggaagcaacagcattgtcacaaacagtattgcaggaagtgtagctgagagctatgatacagagagtgggtttgaagattcagagaatactgacattgccaattctgttgtgcggttcattacccgatttattgacaaagtttgtacagagagtggagttactcaggatcacatcaagagccttcattgcatgataccaggaattgtagctatgcacattgagaccctagaagcagtacatcgagaaagcagaagacttccgcctattcagaagcccaagattcttagacctgctctgctgccaggagaagaaattgtctgtgagggtcttcgagtcttgctggatcctgatggaagagaagaagctactggaggtcttcttggaggccctcagctcctgccagcagaaggagccttgttcctcaccacatacagaattctcttcagaggaacaccccatgatcagttagtgggtgagcagacagttgtgcggagctttcccattgcctccatcaccaaggagaagaagattacaatgcagaaccagctacagcagaacatgcaagaaggactgcagatcacatcagcatcttttcagttgattaaggtagcatttgatgaagaagtcagtccagaagtagtagagatctttaagaaacagctgatgaagttccgttatcctcagtccattttcagtacctttgcttttgctgctggacaaactaccccacaaataattttaccaaaacagaaggaaaagaacacttcttttcgtaccttctcaaaaacaattgtgaaaggtgccaaaagggcagggaaaatgacaattgggcggcaatatttactgaagaagaagacagggacaattgtggaagaaagagtaaatcgtcctggatggaatgaagatgatgatgtatctgtttcagatgagagtgagctccccacaagtaccaccctgaaggcctccgagaagtctacaatggaacagttggtggaaaaagcttgtttcagagactatcagcgtttaggtttaggaaccataagtggcagctcttcccgttcaagacccgagtattttagaattactgcctccaacaggatgtattcactctgccggagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccgctcctacctcctctttagaatcttccagtagcatagaacaagagaaatacttgcaagccttactgaatgctgtttctgtccatcagaaactcagaggcaacagcactcttactgtcaggccagcctttgctctatctccaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatatttggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggacatcactgcacaagtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatctggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccac

SEQ ID NO: 180766 - DNA, 1188 bp, Homo sapiens
  Payload ID: 15601
  Gene Symbol: SBF2
  Gene Name: SET binding factor 2
  ENST ID: ENST00000420722
  CDS Start-End: 1-1188
ggataaagaggtgcgagccgttttccttagattatttgcacaactcttccaaggatatagatcctgcctgcaacttataagaattcatgcagagccagtaatacatttccacaagttggtagcctttgaagtagagagaattaaagttgaagaaaataacccagtgaagatgataaagcatgtcagggaacttgctgagcaactattcaaaaatgagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttgtttcgataatggacaaggtgacgacagttttcaacagtgcacaaagactagaagttgtcagaaactgtatctcattcatatttgaaaataaaattttggaaactgaaaagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggattgttcaagtttagaagaatacaacattgccgcagcattactccctttgaccagtgctttctataggaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggataagcttcctgatgaccattatcaggagaagacagcaatggacctggcagctgagcaactacgcctttggcctaccctgagcaagtcaactcagcaagagctagtgcaacatgaggaaagcactgtctttagtcaggccattcactttgcaaacctcatggtgaacctgctagttccactcgacacaagtaaaaacaagctcctaagaacatcagcgccaggtgactgggagagcggaagcaacagcattgtcacaaacagtattgc

SEQ ID NO: 180767 - DNA, 993 bp, Homo sapiens
  Payload ID: 15601
  Gene Symbol: SBF2
  Gene Name: SET binding factor 2
  ENST ID: ENST00000530741
  CDS Start-End: 1-993
actatcagcgtttaggtttaggaaccataagtggcagctcttcccgttcaagacccgagtattttagaattactgcctccaacaggatgtattcactctgccggagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccgctcctacctcctctttagaatcttccagtagcatagaacaagagaaatacttgcaagccttactgaatgctgtttctgtccatcagaaactcagaggcaacagcactcttactgtcaggccagcctttgctctatctccagggactgaaaggaggacttcaagaatgtccactgtgcttaagcaggtagtgccaggacatttggatgtaaacccatccaatagctttgctcaaggaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatatttggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggaca

SEQ ID NO: 180768 - DNA, 587 bp, Homo sapiens
  Payload ID: 15601
  Gene Symbol: SBF2
  Gene Name: SET binding factor 2
  ENST ID: ENST00000532095
  CDS Start-End: 1-399
ggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtgacatgctgaaccctgctcgctgtgctgaagacttccccacagcacctgaggctaaaccacaggtccctcaataagctaggcctgtgcagtacagccttttataaacttgaaatggatttgctttaatttttgtaatgttttagatgtttctttgaaaagacaaaaaacaaaaattacaactaaaaataa

SEQ ID NO: 180769 - DNA, 7160 bp, Homo sapiens
  Payload ID: 15601
  Gene Symbol: SBF2
  Gene Name: SET binding factor 2
  ENST ID: ENST00000617179
  CDS Start-End: 1-5409
ttttgtcagcctggcgggtggcagctgtccagagagaggaagcagccaacgttctttgtggttgtcctgacagacattgactcagatcgacattactgctcatgcctaaccttctatgaggcagagatcaatcttcagggaacaaagaaggaagagattgaaggtgaagcaaaagtgtctggtttaattcagcctgcagaagtgtttgctcccaaaagcctggtgttggtatccagattatattatccagaaatttttagggcttgcctgggtttgatctataccgtgtatgtggacagcctgaatgtctccttggaaagtctaattgcaaacctttgtgcctgccttgtcccagcggctggagggtctcagaagctgttttctttgggtgcaggagatagacagttgatccagactcctttacatgatagtcttcctatcacgggcactagtgtggctctcctgttccagcaattgggaattcaaaatgtcctcagcctcttttgtgcagtcctcacagaaaataaggttctcttccattctgcaagtttccagagacttagtgatgcttgtagagccctggaatctttaatgtttcctcttaaatatagttatccttatatccctattctcccggctcagctactggaagttctaagttccccaacgcctttcattattggagtacattctgtctttaaaactgatgtccatgaacttttagatgtaatcatagcagatttggatggaggcactattaaaattcccgaatgtattcacctctcttccctcccagaaccacttctacatcagactcaatcagctctttctttgattttacacccagatttggaagtagcagatcatgcttttcctcctccacgaacagctttatcccactcaaaaatgctggataaagaggtgcgagccgttttccttagattatttgcacaactcttccaaggatatagatcctgcctgcaacttataagaattcatgcagagccagtaatacatttccacaagacagcattcttggggcagcgtggtttggtcgagaatgatttcctcactaaagtactcagtggaatggcatttgcaggttttgtttcagaaagaggtcctccttatagatcttgtgatctctttgatgagttggtagcctttgaagtagagagaattaaagttgaagaaaataacccagtgaagatgataaagcatgtcagggaacttgctgagcaactattcaaaaatgagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttgtttcgataatggacaaggtgacgacagttttcaacagtgcacaaagactagaagttgtcagaaactgtatctcattcatatttgaaaataaaattttggaaactgaaaagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggattgttcaagtttagaagaatacaacattgccgcagcattactccctttgaccagtgctttctataggaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggataagcttcctgatgaccattatcaggagaagacagcaatggacctggcagctgagcaactacgcctttggcctaccctgagcaagtcaactcagcaagagctagtgcaacatgaggaaagcactgtctttagtcaggccattcactttgcaaacctcatggtgaacctgctagttccactcgacacaagtaaaaacaagctcctaagaacatcagcgccaggtgactgggagagcggaagcaacagcattgtcacaaacagtattgcaggaagtgtagctgagagctatgatacagagagtgggtttgaagattcagagaatactgacattgccaattctgttgtgcggttcattacccgatttattgacaaagtttgtacagagagtggagttactcaggatcacatcaagagccttcattgcatgataccaggaattgtagctatgcacattgagaccctagaagcagtacatcgagaaagcagaagacttccgcctattcagaagcccaagattcttagacctgctctgctgccaggagaagaaattgtctgtgagggtcttcgagtcttgctggatcctgatggaagagaagaagctactggaggtcttcttggaggccctcagctcctgccagcagaaggagccttgttcctcaccacatacagaattctcttcagaggaacaccccatgatcagttagtgggtgagcagacagttgtgcggagctttcccattgcctccatcaccaaggagaagaagattacaatgcagaaccagctacagcagaacatgcaagaaggactgcagatcacatcagcatcttttcagttgattaaggtagcatttgatgaagaagtcagtccagaagtagtagagatctttaagaaacagctgatgaagttccgttatcctcagtccattttcagtacctttgcttttgctgctggacaaactaccccacaaataattttaccaaaacagaaggaaaagaacacttcttttcgtaccttctcaaaaacaattgtgaaaggtgccaaaagggcagggaaaatgacaattgggcggcaatatttactgaagaagaagacagggacaattgtggaagaaagagtaaatcgtcctggatggaatgaagatgatgatgtatctgtttcagatgagagtgagctccccacaagtaccaccctgaaggcctccgagaagtctacaatggaacagttggtggaaaaagcttgtttcagagactatcagcgtttaggtttaggaaccataagtggcagctcttcccgttcaagacccgagtattttagaattactgcctccaacaggatgtattcactctgccggagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccgctcctacctcctctttagaatcttccagtagcatagaacaagagaaatacttgcaagccttactgaatgctgtttctgtccatcagaaactcagaggcaacagcactcttactgtcaggccagcctttgctctatctccaggtgtgtgggcaagtcttcgctctagcactcgcttgatcagctctccaacatccttcattgatgttggcgcccggctggcaggcaaggatcactcggcctccttcagtaacagcagctacctacaaaaccagctcttgaaacggcaagcagccctttacatatttggtgaaaagtcgcaactaaggaacttcaaggtagaatttgctttaaattgtgagtttgttcctgttgaatttcatgaaatccggcaagtgaaagccagttttaagaagctgatgagggcttgtatcccaagcaccatccctactgactcagaagtgaccttcctgaaagcgctgggagattctgagtggttcccacagcttcacaggataatgcagctggctgtggttgtatcagaagtacttgagaatggttcctcagttttggtctgtttggaggaaggctgggacatcactgcacaagtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggttcacaaccagtatccaactgagtttgaattcaatctctattacttaaagttcttggctttccactatgtgtctaatcgctttaaaacatttctcctggattcagactatgaaagattagagcacggaactttatttgatgataaaggagaaaagcatgccaaaaaaggagtctgtatttgggaatgtattgacagaatgcacaagaggagtcccattttctttaattatttatattcaccattggaaatagaggctctaaagcccaatgtaaacgtctctagcctcaagaagtgggattactacatagaagagaccctgtccacaggcccttcctatgactggatgatgctaacccccaagcacttcccctccgaagactctgacctggctggagaagctgggccacggagccagaggagaacagtgtggccatgctatgatgatgtcagctgtactcagcctgatgctctcaccagccttttcagtgaaattgaaaaattggagcacaaattgaaccaagcccctgagaagtggcagcagctgtgggaaagggtaaccgtggaccttaaagaagaaccaagaacagatcgctcccaaagacacctgtcgagatccccaggaattgtgtctaccaacctaccttcctatcagaagaggtctctgctacatctcccagacagcagcatgggggaggaacagaattccagcatctccccatccaatggagtggagcgaagagcagccacgctctatagccagtatacatccaagaatgatgaaaacaggtcctttgagggaacactttataaaagaggggctttgctgaaaggttggaagccccgttggtttgttttggatgtaacaaaacatcagctgcgctactatgactcaggtgaggacacaagctgtaaaggccacattgatctggctgaagtagaaatggtcatccctgctggccccagcatgggagccccaaagcacacaagtgacaaggctttctttgatctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctacttgtaatgcctgacctttgagatgctcagttctctggtgctgccaaaagatgcttccatggtccgtgctctgccagtggggttcacaacaagagacgtcattgttcagtagcaggcaaagagggagcacacagcattattctgatggaaaaagattatccagggaatggtacaacaatgaccagcccaatgcaggaaaacactacttccaaaacactgaattctctagaccagaggtgctctgaggatccagggccttgtgttcttatgtatcttctgcttcctgacagcttctttttcaaaataacatgcaaaaaaagctgaatgcactaactcacaaaacaaacacttgcactgaattcccaatgaagtgaagatgttggaaagacagaggccagctatttaggaccatacgcacctgtgacaagggctgtgttgaccacagtcacactgtggcatgactggatacccaaactacacttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatctggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccac

SEQ ID NO: 180770 - DNA, 9899 bp, Homo sapiens
  Payload ID: 15602
  Gene Symbol: SETBP1
  Gene Name: SET binding protein 1
  Uniprot ID: Q9Y6X0
  ENST ID: ENST00000282030
  CDS Start-End: 297-5087
ggttaagtggagctagagagctacattgtaacctagttggatttttttggggggggaatgtatcagaatctaacgtgtcgttaatagaaagaagaacaggcaagaagtggtccagccggcgaagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacaggcttacgagaggccccagaaacattcaactctccattatgacacgggcctcccacaggacttcaccggtgacaccttaaaaccaaagcaccagcaaaaaagcagcagccagaaccacatggactggtccaccaactctgacagcggacccgtcactcagaattgcttcatcagtccagagtctggcagagaaactgcaagcaccagcaagatccccgctcttgagcccgtggcttcctttgcaaaggcccagggtaagaaaggcagtgcagggaacacgtggagtcagttgtctaacaataacaaagatctgctcttgggaggtgtggctccatccccaagcagccacagctcaccagccccacccagcagctctgctgagtgcaacgggcttcagcccttggtggatcaagatggaggaggtacaaaggagcccccagaaccacctacggtgggcagcaagaaaaagtccagtaaaaaagatgtgataagtcagaccataccaaacccagacctggattgggtcaagaatgcccagaaagcatttgacaatacagaagggaaaagggaaggttattccgcagatagtgcccaagaggcatcaccagccaggcagaacgtgagttctgccagtaatcctgaaaatgactcaagtcatgtccggattactatccccatcaaggcaccctctctggatccaaccaaccataagaggaaaaaaagacagtccattaaagcggtggtggaaaagatcatgccagagaaagccttggcttctggaatcaccatgagcagtgaagtagttaacaggatactttccaactctgaggggaataagaaggatccccgtgtccctaagttgagtaaaatgatagagaatgagtccccctcagttggccttgaaactggtggaaatgctgagaaagttatcccaggaggtgtgtctaagccgcggaagccacccatggtcatgacacctccaacgtgcacagatcactctccatccagaaagctgccagaaatccagcatccaaaatttgctgcaaaacgaaggtggacttgcagcaaaccaaaacctagcaccatgcttcgagaggcagttatggccacctctgataaactgatgctggagcccccgtctgcatatcccatcaccccatccagccctctctacaccaacacagacagtcttactgtgatcactccagtcaaaaagaagcggggacgaccaaagaagcagcctttgctcacagtcgagacgattcatgagggaacttccaccagccccgtcagtcccatcagccgagagtttcctggcactaagaaaagaaagcgacgacgcaatttagcgaagttggcccagctagtgccgggagaggacaaacccatgagcgagatgaaatttcacaagaaagttggaaagctcggcgtgttggataagaagaccatcaaaactatcaataagatgaagacactcaagaggaaaaacatcttgaatcagatcttgtcctgttccagcagcgttgctctgaaggcaaaagctcccccagagaccagccctggggcagcagccattgaaagcaaactgggcaagcagattaatgtcagcaagaggggaaccatctacattggcaagaagcggggcaggaagccaagagcagagctgccacccccatccgaagaacccaaaacagccatcaagcaccccaggcctgtttctagccagccggatgttccagccgtgccttccaactttcagtcacttgtggcgtcttcaccagcagctatgcacccactttcaacacagttaggtgggtccaatggcaacctgagccctgccagcactgaaaccaatttttcagagttgaaaactatgccaaatctccagcccatcagtgctcttccaaccaaaacccaaaagggaatacacagtggaacctggaagctgtctccacccagactgatggccaactccccttcacacctgtgcgagattggctccctaaaggaaatcacgctgtcccctgtgagcgagtcccacagtgaggagacgatccccagcgacagcggcattgggacagacaacaacagcacttctgaccaagcggagaagagctcagaatcccgaaggaggtactcttttgatttctgctccctggacaacccggaggccattccgtccgacaccagcacaaagaaccggcatggccaccggcaaaagcatctcattgtggacaactttctggcccacgaaagcctcaagaagccaaagcacaagaggaaacggaaaagcctgcaaaaccgcgatgacctccagtttctggcagacctggaggagctaatcaccaagttccaagtgttcagaatctcccaccggagttacaccttctaccacgagaatccatatcccagcatttttcggattaattttgatcactattacccggtgccatatatccagtatgacccgttgctctatcttcgtaggacttcagacttgaagtcaaagaagaagcgtggtaggcctgcaaaaaccaatgacaccatgacaaaggtgccttttttacaagggttcagctaccctattcccagtggaagttactatgcaccctatggaatgccttacacatcaatgcctatgatgaaccttggttattacggtcagtacccagctcctttgtacctatcgcacacgcttggagcagcttccccattcatgaggccaacagtgccaccacctcagttccacacaaactcccacgtaaagatgtccggtgcagctaagcataaagccaagcatggagtacacctgcagggacctgttagcatgggccttggtgacatgcagccttctctgaaccctcccaaggtaggcagtgccagtctgtccagtggtcggctccataagaggaaacacaaacacaagcataagcacaaggaagaccggatcctagggacccatgacaacctgagtggtctttttgcaggcaaagccacaggcttctccagccacatcctgagcgagcggctgagtagcgcagacaaagagctcccgctggtgagtgagaagaacaagcataaggagaaacagaagcaccagcacagcgaagccggccacaaagcttctaagaacaactttgaggtggacaccctgtctacactgtcactttccgacgcccagcattggacacaggccaaggaaaaaggagacttgagcagtgagcctgtggactcatgcacgaaaagatactctggcagtggcggggatggtggcagcacgagatcagagaacctggacgtgttcagtgaaatgaacccttcgaatgacaagtgggacagtgacgtgagtgggagtaaaaggaggagctatgaaggctttggaacgtacagggaaaaggacatccaagccttcaagatgaaccgcaaggagagaagttcttatgactcctccatgtctccagggatgccaagtccccacttaaaagtggaccagacagcagtgcatagtaagaacgaaggctcagtgcccaccatgatgaccaggaagaagccagccgcagttgacagtgttacaattccaccagccccagtgttatctctccttgctgcatctgcagcaacgtcggatgcagtcggctcctccctgaagaagaggttcaagcggcgggagatcgaagccatccagtgcgaagtgcggaagatgtgcaactacaccaagatcctgtccaccaagaagaacctggaccacgtgaacaagatcctgaaggccaagcggctgcagagacaatcaaaaacaggcaacaacttcgtgaagaagaggcgcgggcgtcccaggaagcagcccacccagttcgatgaggactccagagaccaaatgccggtgctggaaaaatgcatcgacctgcccagcaaaagaggccagaagcccagcctgagcccgctggtgctggagcccgccgccagccaagacaccatcatggccaccatcgaggcggtcatccacatggcccgggaggcgccgcccctgcccccgccaccgccgccgcccctgccgccaccgccgccaccacccctgcccccgccaccccctctacccaagaccccccgaggcggaaagaggaaacacaaaccgcaggcccccgctcagcccccacagcagtcgcccccgcagcagccccttccccaggaagaggaggtgaaagccaaaaggcagaggaagtcccgagggagtgagagcgaggtccttccctagggcgggtctgggcgtctgcacctggggcctagggaactgacacgtgggaagcgcagtgagccggggcgggggcggaatcccccgctgcagggacacccacgcccttctctccagaagccgggcaggcagaatccggccagacgacggggctgagccatcaggagctcttgggaaagcaaagcagggagacaccttcagaagaagcttgtctgagcttcaccgcagctcccaccacgcggcgcttcagtacggctggatcctccgcaggcgagcggaaggcccccaggaggagcaggctggtggcactctcctgacctcacgctgccaaggtgcgccctcgactcccgatttcatttgctggccaggaaaatcgaaagggaaacaccctcaattaggaaacattccaaggggagaaaagctgcaaattgctcaactggcattgctgtaacccgttccatttaattggtttttatttcttttgattttcaagctctgctaagctttggggtaccaacgtcatcttcaggtgacctgaatctttcccttaaccgtacagtttctcgatggaattgtgtgatcagaaggtggaattctagtgataggcgacctcagacccgcattcatgttctgtgtgcctcttctattgcacatacactgatttttagcattgtctattcctatttttcctttgcccattgtacttccatatatcttttcattaacttacttgctgccttttttttttcttggtacacatttaaataaagtaatccttaacctgtgctgtaaagttcacccttggcatgctgttccaagaacctgggtttgaatcccaatcgttgtgaaacatactcagtattgataaaacctttttaataagtgatgcagagcagccaaggatatgttgacccagatgtcaaccaggctatttttatacttaaaacatgtcagcagagcataggcagaataaaatggtttaaataccccacagcaaatagagtaactgacaaaccaccaaaaactgaaaccccagacccaccagaaagacaagtgtctagcaatgccttggtacctgatctttttcattcaaataattgtcataggttgttcaaaaaaaaaaaaaaaaaggaaacaaaaacacaatagaagtccattatcccttgataattatttcttaaaagcaaatgggagtaagtgttcttatctggaaaaataaataaataaaatgctcaaagggtatcaccacttcaattttatcaagccaccttggacaaagtatccaaattgtggttgccttaataaactaaaacattattgtacataatgtaattataaatctatcagtctgcatggatgcaaactgtgtgtgacaaatcgtcttttaaatggtcaatttcagctgtacatttctcatccaagttgtactctagccattggtttagcgtggacagatactccatctctattatccatttccacagcccaaataaaatatgttaagcaggctcagaatgaatatgaagaattccatttccgtagatgttttctaaaagtcagattgtggaaatttcaaataagtattttcaatttcctccctcactccctcttaccttccccaagacatcaaacacctggcatggtagattatagaaagagacactgagagagagaattaaattttctaatgggaattagaatatctggtttacctccaaattaagtttctttacaggaagttgggaccagctggaaattgtattatcatttcggaacacaatattacttccttagagagagatggatttttgttggcaacataaaagaataagtgatggggtatctatgtgagtaaatttttaaattccaagttaatatgcttgcaaacattactgctgcgttatggcaccaagagttggttgaaattacccacgtagtcatactcctgtgctctgtcaccatggacttcacatcatttgctgcccactagttcaatcgcatttaatcctagcaatatgtaagtttaaaggactgcattcccctctactttaaagcttatatcctagatactcagtttgtgaccttggttgacctttggcatttcacgcaagttgaacagcaaaatcaaagcagccatttttaattcgtcattcccaagccctatctgagtggttccaaagtcacctgagaggaaggtttaaattagtccctctcaccccaccattgctataaaacagcaacgttttcattccaattcagccataaagaggtttctcttcttactgggttttgaaatcatttccttttttctttcgtttgcccttcttccttcctgtgttgtactatctctccaaccacgtctataagcagactcaatcttcttgcagaggaagatgagctggcactctgcaaacttctttaataaggacccaaagtttacttgacattaacctctagtaggtgagaaattccaaaaaagctttggggtacattagaatttccaaagctctgaaagatatttcaggagatttaacagcagagttgcaacttacacgtgaattctggtctatagtggtcatgtgagttaaattcgaatcctctacttgtatgaccctaggaatagattggaatactgcagaggaccaaagctgaggcatgctaaacagctgcttggaggtggaagcaagttcagtcacctactcagcttcctctctccaccacccagttcctccctcagtatcacattatttttttcttctgcttttcattaacctaactcatctcatcagtacaaccattttcttattctctaactacccccaattcctttagcctctccccacctgtccaaactcagctcagccgtgggccaatgcagcttacagacggttgcagagctaggaagaaaacccagctctcccaaccctgatcgtggaggtctctggccccccaacactgccttctgggggctgcattttttttttttttttgagaagaggtcttttgggatgcatggtgctccacatacagcttcacaaaatatttcattataagagaaaccccttgatttttatttctttttcttttgttttctggattacctgccttcagtaagcagatgcagacccacttgtaaggagtctggttagtgatgagaaaaggatgaaatctagatacaaaagtcaccttgaaggtgatgatggatctttaatccacttgactaagtgtctggaagagctacttgctcttccacccctcatctcaaatgagaggagcagaagtttaacttcctcaaatagcccagctctggctaaaacccaaagaagaaaggtcaaaggaagggaaagcatgtcaggggctggtttgtgacttggcaggaccaggaaacagcagccactgacagcccagagaaggtgactaagggctggcagaagattagaatgttaatttggctgctgtccggactaggaggccatgttcaatggcagtcagaatttgtgttctgcgcattgctgggtctataaatatgataagcaagtggtgacagaattatagtataaggtgatgtactacatgcagatcataaaggctttggttttaagacttaagtagaaaatccctctcctagcttattacccaacaatattcagataatgagcttttggagaatatctttttcctatcactagaaagatttacctgggaactgtctaaagtctacacacatatttccaaagcctttaaataccaactgcagcatggagagagaggggtggcagaagctgaaatgcctcaaaagccatttaagtgttacgttgcaggattttcagtccttctcgttatgtaaaagtagataaatatagacgttattctcaacactaccctatagtatcacagtggtccaaatgccagagcttacagataatgtcatcacagtgcctagaaactcgaactgtaatatatcgtagcattttcttggtgtttcttaaagtttctttccacaatacaaggtcctctctgcctcttgtttcttggagagttcaccccactgatgagtcttccttccctgttggactcagtcatttggggaacagtcttagaagcacatatcaaccaaggaagaaacttcctggatatctattgcccacttgcccaggtctaataaacactaaaggggggaaattgaaaggagctgccaactggtcaacgtggaagggcggttccaccctagattggtgtctttctttttcttcctttttttaaaaaaaatctatttcttaaataataataaatgcacatgatgtgttaaatatgtacatatatatttcaaaagaaaaaatggggcacaagattgtcttacaagtcgtgctggctaatttttagtttgtattcataagtggtttttaaaagccttttttaaagtgtaatttgcatgttctactttgattgtatgtaaacatattttagaacaaaaaatgtatttgtattttattgaatatagaggcaagaaaattgtacattgtttgaaatgttctttttgtaacagtttttattcataaagcatttttgtacatttaaaatgaacatggacttgctgttatttgaggcgtagatacatctagcatgcttactgtcatgctcctccatggtcttagatgttgggttttaaacatttttttctaaaagaaagctcagtcttttccgctaccagatcaggttagcacagtatagagcacttaactattaaaaaaaaaaagttaatcctattcatatgttattcattgtgtgaaattaaagacattcaattcagtctaa

SEQ ID NO: 180771 - DNA, 1785 bp, Homo sapiens
  Payload ID: 15602
  Gene Symbol: SETBP1
  Gene Name: SET binding protein 1
  Uniprot ID: Q9Y6X0
  ENST ID: ENST00000426838
  CDS Start-End: 396-1124
aagcgcggggccggccggggcgcccgccgctcgccgccgcctccgcgcgcccgggggccccggcgccccccgagctagggcggccagctcgcggctcgccgtttgacagatgctcatcgccatggagttgccgcagcagcacctttgggggctcgggcgagcgacgggagccgggatctgagcgagcgccggggccagcggagccggagccgccgggacatggttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggggaccagaaggtgtcccgtgctggaaaaaatagcaaagccacgaaggaggaagaaagaagccactccaaaaagaagctcctcacagccagtgaccttgcagccagtgacctcaaaggatttcagccacagattaaagactccagtaaggaggaagtctggaagagaagaggaggccaaggcatcccattcaaaaagcaattcctgtcccaggaacgtgccatgtgcttctcatgcccccggaacccattccccgcaaaacccggttctctcactcttccttttcacagtgaacctgcagtctgggcacaagaagtataacttcgcatggattctgcaaagcccacacctgtggtcattccctgttctttccattcaacaatggagacttgcccaagattgtaaactagtgagtgacagcatttgggcttatgatcttctctgcctgctagctagacattctctctgggtctaaaagataatccaaaaagatccagcttcacaatgctgccctgaagagataatgcattaggcggccctgatgcagcattcactgtcttccagggcaggcttgatcccatgagtttgcttgctcagacgatcacttaggaaacacatgcctttactctctaggccttttttctagcttgccttgtatcagctatgccatggatctttgctctcttaccccatgctatacagagtatgggctccaagccacagctggcctgtcaagtgtgtgtcgctggtccaccatgggatacatttagaaacttttatagcaatttgacatttttgtgatatccaagcatgtgattgttttcctacggatttgtcttatagtattttaccaaagtttccacacaaaaagtatggattaaggacaaagtatctggtccttcatcaaagatcgtttgataagctctgttctagttaaccaacactgagctttcctagttttaataaaagagtaggatttgga

SEQ ID NO: 180772 - DNA, 762 bp, Homo sapiens
  Payload ID: 15602
  Gene Symbol: SETBP1
  Gene Name: SET binding protein 1
  ENST ID: ENST00000591940
  CDS Start-End: 352-762
gcgtgagcctgtgcgtgtgctcacacgcgcattttggcagggctgaatcacaagaggactcgcagttgatacccagactcaccaaaaaattgagctgtgaatttggggaggcaggtacgtgctgggaaggaagctaaaggagaacaacagctttgtgtgctgatgaagtaaacagacagttgcagatctgatctcttctgaacacctcatcgtgtctccatccctgggaatctgaccctagcaactggaccactttgttcttggaattttgggtgtcctcttttctcacctttcccttttcccttttccccttccccctcctgagaactccggaagactgtagagattgtcatggagtccagggaaaccttaagcagctcccggcaaagagggggcgagtcagacttcctgccggtctcctcagccaagcccccagctgctcctggctgtgcaggagaacctttgctctccactccaggacctgggaaggggatcccggtgggcggagagcgcatggagccagaggaggaggatgaactaggctcagggcgggatgtggattccaactccaacgcggacagtgagaaatgggtggcaggagatggtttggaagagcaggaattttctatcaaggaggcaaacttcacagagggaagtctgaagctaaagattcagaccacaaagcgggctaagaaacccccaaagaatttggagaactatatatgtccacctgagatcaagatcaccatcaagcagtctggg

SEQ ID NO: 180773 - DNA, 701 bp, Homo sapiens
  Payload ID: 15603
  Gene Symbol: SETMAR
  Gene Name: SET domain and mariner transposase fusion gene
  ENST ID: ENST00000358950
  CDS Start-End: 65-701
ctcccagtcgcgaccttttgtcttctcttacagcgcacccgttggtgcgcgggaataggtgtgcatgccccggcctgggcctttttctgttgacccacggcatcaccttagcaagggtgttgtccttttcagtccattccctgaagcgcagaaccggaggccttgtgagaacctggctttttgtccagtcctgtcctcagaactcaaggaggcatcacggggggagtcatttacctccctggtctcaggtgtctctcacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagc

SEQ ID NO: 180774 - DNA, 2443 bp, Homo sapiens
  Payload ID: 15603
  Gene Symbol: SETMAR
  Gene Name: SET domain and mariner transposase fusion gene
  Uniprot ID: Q53H47
  ENST ID: ENST00000358065
  CDS Start-End: 68-2122
acaagtcccagcatccaccgcgcggcccaggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagcctagttataatgatttaaaattcacagtccaaaaccgcagttagttttgcaccaacccaatatcttcatagattgaaatataaattaaaattgcatttgaagtagattccacggactttattaagaatgtagaaatgtggcctggcatggtggcttacaactgtaatcccagcactttgggaggcccaggcgggcagatcacttgagtccaattgttcaggaccagcctgggcaacatagtgagaccctgactctaataaaataattttttaaaaaaagattaaaacatgtaccttgaaaagcat

SEQ ID NO: 180775 - DNA, 1676 bp, Homo sapiens
  Payload ID: 15603
  Gene Symbol: SETMAR
  Gene Name: SET domain and mariner transposase fusion gene
  ENST ID: ENST00000413809
  CDS Start-End: 40-555
aggactgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagccta

SEQ ID NO: 180776 - DNA, 1359 bp, Homo sapiens
  Payload ID: 15603
  Gene Symbol: SETMAR
  Gene Name: SET domain and mariner transposase fusion gene
  ENST ID: ENST00000425046
  CDS Start-End: 35-238
tgtcagggtagtgggcgttgcgtgaggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagccta

SEQ ID NO: 180777 - DNA, 1671 bp, Homo sapiens
  Payload ID: 15603
  Gene Symbol: SETMAR
  Gene Name: SET domain and mariner transposase fusion gene
  Uniprot ID: Q53H47
  ENST ID: ENST00000430981
  CDS Start-End: 11-1108
aggcgggtaaatgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaaggtttgtctgtgaatatgctggtgaggttttaggattctctgaagttcagagaagaattcacttacaaacaaaatccgactccaattacattatagccatcagggaacatgtttataatgggcaggtaatggaaacatttgttgaccctacttatataggaaatattggaagattccttaatcattcttgtgagccaaaccttttgatgattcctgtccgaattgactcaatggtacctaagttggcactttttgcagccaaagatattgtgccagaagaagaactctcttatgattattcaggaagatatcttaatctaacagtcagtgaagacaaagaaaggctagatcatgggaaactaaggaaaccttgttactgtggtgccaaatcatgtactgctttcctgccttttgacagttctctgtactgccccgtagaaaagtcgaacatcagttgtggaaatgagaaggaacccagcatgtgtggctcagccccttctgtgttcccctcctgcaagcgattgacccttgaggtgagtctgttcagtgataagcagcttgcccctccctatagtggaagacagtggttggctagctttacctctgcctagttacataagtttaactcaggaatgtggcagagactgcaagttgtccatcagtatcctttcccctttctgtaatagaattctccatttaacaaaagtacatgactacccagaatactcactttcctagttagatttgtcttagtgactgttctagttaataggatataagcaaaaatgacaagtccttaaatggagatatcctgcccttcacctcctctttcttcctgctggctggaatgtatacatgatgactggaactggagcagtcatcctagaccccaggatgaccctgggaaaggaagccattgcatagaaaaatcaacaaggttaaaaggagtctaggtgtctggtactgtagaacatcctgtcagtcgtgatctgacacctttgtactttcaggtgagaaatagtctctcccttgcttaagtcactgttattgtaagttttctagcactaacatcgaacctaataatgatccaagaaacccttgtggctgcatacctaaaccctgcttgccaaccaattttaacagtaataaagctgactttttgatttctgtctga

SEQ ID NO: 180778 - DNA, 1657 bp, Homo sapiens
  Payload ID: 15603
  Gene Symbol: SETMAR
  Gene Name: SET domain and mariner transposase fusion gene
  Uniprot ID: Q53H47
  ENST ID: ENST00000425863
  CDS Start-End: 1-1638
atgttcgcggaagcggcaaagacgacacggccttgtgggatggcggagtttaaggagaagcctgaggccccgactgagcagctggatgtcgcgtgcggccaggaaaacttgccggtgggcgcgtggcccccgggggccgcgccggcgcccttccagtacactcctgatcatgtagttggacctggagcagacattgatcccactcaaataacctttcccggatgcatttgtgtcaaaactccctgcctccctggcacttgctcctgtctccgccatggagagaactatgatgataactcatgccttagagatataggatctggaggaaagtatgcagagcctgtttttgaatgcaatgtcctgtgccgatgcagtgaccactgcagaaacagagtggtccagaaaggtctacagttccacttccaagtgttcaagacgcataaaaaaggctggggacttcgtaccttggaatttataccgaaaggaagttctctgtactgccccgtagaaaagtcgaacatcagttgtggaaatgagaaggaacccagcatgtgtggctcagccccttctgtgttcccctcctgcaagcgattgacccttgagactatgaaaatgatgttagacaaaaagcaaattcgagcaattttcttattcgagttcaaaatgggtcgtaaagcagcagaaacaactcgcaacatcaacaatgcatttggcccaggaactgctaacgaacgtacagtgcagtggtggttcaagaagttttgcaaaggagatgagagccttgaagatgaggagcgtagtggccggccatcagaagttgacaacgaccagttgagagcaatcatcgaagctgatccccttacaactacacgagaagttgctgaagaactcaatgtcaaccattctacggtcgttcgacatttgaagcaaattggaaaggtgaaaaagctcgataagtgggtgcctcatgagctgactgaaaatcaaaaaaatcgtcgttttgaagtgtcatcttctcttattctacgcaaccacaacgaaccatttctcgatcggattgtgacgtgtgatgaaaagtggattttatatgacaaccggcgacgatcagctcagtggttggatcaagaagaagctccaaagcacttcccaaagccaatcttgcacccaaaaaaggtcatggtcactatttggtggtctgctgctggtctgatccactacagctttctgaatcccggtgaaaccattacatctgagaagtatgctcaggaaatcgatgagatgaaccaaaaactgcaacgcctgcagctggcattggtcaacagaaagggcccaattcttctccacgacaatgcccgaccgcatgttgcacaacccacacttcaaaagttgaatgaattgggctatgaagttttgcctcatccaccgtattcacctgacctcttgccaaccaactaccacgtctttaagcatctcaacaactttttgcagggaaaacgcttccacaaccagcaggatgcagaaaatgctttccaagagttcgtcgaatcccaaagcacggatttttacgctacaggaataaaccaacttatttctcgttggcaaaaatgtgttgattgtaatggttcctattttgattaataaaaatgcgttgagccta

SEQ ID NO: 180779 - DNA, 7365 bp, Homo sapiens
  Payload ID: 15604
  Gene Symbol: SETD7
  Gene Name: SET domain containing (lysine methyltransferase) 7
  Uniprot ID: Q8WTS6
  ENST ID: ENST00000274031
  CDS Start-End: 638-1738
gggaacacggacagtgcacgacggactttcaagttgctcccggcacaacgggaggtcgggagctcggagcccctacgggcggtccaagtgtccgcgagaagcccgcagcgcccaggaccgcgttgagcgctcggggcgcgccaagccgcacctaagcaaaagagaaacgctgacgggccggaggcgggttggctgggacgcggaatacgcgcggccccggagcgcctttcgttttaaggagccttacttctggaaagggacagggaactgtcaatcagcgagggagggagcgcaccggcgctgggtgatgtcagcggatcagctgctcgataacaaagagagggtattacaggagaaagttgcagcagcggcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatatgtttgtccacccccgttttgggcccatcaaatgcatccgcaccctgagagcagtggaggccgatgaagagctcaccgttgcctatggctatgaccacagcccccccgggaagagtgggcctgaagcccctgagtggtaccaggtggagctgaaggccttccaggccacccagcaaaagtgaaaggcctggctttggggttcagagacctggaatagaaacttggatctatgcactacgtttatctgacaatgggacaaccagggactgctcatgctgtgacgtcacatcctctcaccatgcgttagcaacgactttctcgcatactaactaggtttgactgtattactcataccagatttaaaattagctagccttgcaacaacgtcctactgagaggtattgtcgagcatttgacataagacagcgtgatgttctttggtggttcaagtctaaatctgtaccacattcggagatgccaaatgattagactgaaacagggaaacggggtttttcagtcatttttagtcagtggtttttccatagtgcttttttcctatggccagtgcaaattgtgttagcacacttgcatatgtgccgtattaagggttgacaattactacatctttattctctaaatgtagtataatttgccttttaacctttgatctgtatcttgcaatagaatggctttggtttttttcttagtaaataggagcccacttctaaagtcatttcacccctcagccctattctctttcttagataccctttacaagagaaaacttccaaatggatttttgcatcaatagcagtgtgtaggtctctctggttctttctatatcatcattttattattatgtcctaatataaagtactggctcatagggccagggtattattatagaatattattctcgcatgtaaacaaagatatctttgctttaagatgtgagaagaaatgaatttactttgtttgcattaagttatggaagagttgtaatatatactttaagaaagaagagaagaaaactagtatctctaagcggtaactatggcaattttgcaatattttcagtagtgctagtaattttttcctccttgagtacacattaaatgtacataacatagcgcggtcaggcttgtggcacagtgcattgaattcaaaagtcaaacagcaaatttgaattctaacagaattcaaaaaaaaatttttttagtcagtactactaaggcagacacactgattactaggtacaaatcaaaccttgatgctaaaactcttcatcattgtaatttcaaagcacttacctgcttcaaaacattgtaaactaagactgaacacctgtatagtttaaaagcaacactatcaatagcatttcagccattttgccagccatgtgtaatcacaactgcagaaataaggagaaaacccctgtttttttagtttagctaattagatctgtaacatcactgggattgctctgaatgaatcctgagagttttgttttttataagcaccctcaccacatgccatagctttgtctcttttagacacctcgatgcagcggctggaaggactggagagcagctgttgtgctgatctgtagctgtcagctgtgattcctgtcacctgagtcagtttggtctggaaagcgaaggccttccaagctgtagcagatagtgagctccagctgatgagagaaggcttcagtggaagaagagtgaggacataggcagaaggaagtttgctatttcttgtcagttgcacattgctttatgaagactacaacaaaagtgcttaatcccaggctgctcatgactttcatttcaggtggcccttgggcacattgacagagttgcccttcccttctttgcaacaccaggcttcctagagcacccggttgcatgctttgcagctaggtggcagtggtttcagggagatccagttggatccctgcttgaaagcttaagccaatggttcacccatgagaggaagttgtcagtgcttccaggaagattgcccaccaaaggaactgaatagtttttagatttaaaggcaccaggatagggtcactcttactctgtagaaagagaccgttctatacactgtgacggatgggccagggcctctggacttgcattctgataggtgctttaatttaaatgtgcccaaagggagtgactgtcttcaggagaaagatggcttgcattaacctcgatcaagtgggttgtgcagccaggtcagggaatacggtcagggagaggatagtgctggtcatgcccccgatgcagctatgctctgaatgatttcattcctgagagtgatagcattctggtcctggctgcagtggggtacaatttacgtcctaagtgggggctactctaattatcccattcaaatggaatttttttcaacattggatagaaggaattgaagagttgtaagtagtgattagtctgctaatcagttcttcagatgagatattgaatggtaacactctgagcttaaaactcagcagtgtgtctgtgacctccacgcaaatcagaggaagcaatgcatccacgctgagcctcaccatgtcttcctcccaactctcttcatactctctgtgtcttccagctcttctttctctggccggctctctttcctcttctctctgcatatgtgagaacgcctgggcatcctgggtaacagcagccccagctgccctctcctgttccctgttccaagtcccctgcactgacctttcttgagtctctctggctctgtgcatgtctttgggactctgctcatctggcttttcctctgtgtgtgcctctctgtttgcttatgtctctggctctgtcttccccacccctcccctcacacacacacatactcccaaatgtaaggctctgtggcaggttggaatcggagtaaggcttgagattcactgagttctgtaggtagggaaagaagtcaagggagtggaggttctataaggaattaacagctgaggacggaagggtttgtttcccgtttgaacctaaacgcaagtggaaaagaatactcagaatgtatttttctactttacatctgctggggaaggaaatgtgtcaggaagccgctgcatctggtcatttcatcgcatcagaatcacagcagacgtggaagattccatgtggtggggaataaagaaataactttatgctctcctgaaaaacagcgggagcctatgtgtgtgtgcgacactgtaatctcaaggagattcactcagagctgtctcagtccaactcctgcatgaccagatcttcccttagcatcttttctgtgatgaaatattatcttgtgttagagttaggaataggaactaacctgtaggagcatgtccccaaatggacatttgaatggactaacaaaaacaactggaaagactgaatttccgacacaaaggaatgatgggatcaaaaagaaagcagtgaggagttcttgagtcttgtagtacctattcttattttaacttgcttcatccttgatctacctgagacactaagaaggaaattagttttccaagagctctttgaacctgtctaggactgtagttaaacctatttgccctatgggggttcttcacactcgaaaaactatttccttatcaccaacgacccacccagaaaggccaatgaggccaaatgtaacaatttttaacatttaaatataactattaaaattgcattaattgtgaacagtgaattaaagggttgtcttctccaggagacagtatgtggcacttttcgtaaatttcatttaatatataaaaatttaaatcactcactgcaacatgcatttaaaatcttccaagaaggtagaggtatcattttctgttttgctttgttttaaaacagttgcctcaagcttctgtcttaagagtagtgacttagaatccagatatcttttgttttagaaaaacaagcaaaactatgttgcaagactgacagttgtaatgtttatttgccacagatcaaaggttcacaaagtatatcaaatttacatctacttggggtaccttgatagattattattgtttttcttttatctttcccttcaggaatttggaaactcgttgtcactttttttaattttaaaaatactaaattgtaatagttttcttttgccaaatgtgtgcgtacatattcaaagcaatgaaactatttcaagccatacaaccacaggggtgggaacccttttcacaaattttaatgtgtttgtatgtaaatagatgtttgtatgaaatattttcatgatagaatgaatatatttaaatgaagttgaattattccagtgctacttaaacacattacaaaaattttggtgagaattatctgagtctattgagatgtaatgcagatcaattttgatttttaaaaatcaaaagcctacaataactctgactctcagcaacttcctcggcgttgttgcacctgacgtggagagagctcgtaggcttccccagtgcctcagccgcttcctggtggaagttaggtgctaatggaggtgtgttcaccttttagtgatatcactgcaggcctttgaggggcctgagagtgaatcagaggcattagagacaccggtgcagttatctggagcacaatttctttgcagggcagcagaatcagaagccagacttggccatgtgaacctcgaaactcggtttcccggccgccatcaaccgccacccttactgcctagtcacacacgtcagggaggctgccctcagtggagttggggttgagaccccagggtgggacttcacagttttgccagcaatctctaccttctgacttctgcctcgcagagaggaaggagaggggagcatctggcaaggggcccatttctcagcacagtacatttcctgtctcagctctggaagactatgcacccaagcaccaaacttccaaccagagagagagacgtcctccgataacaaaaatccttgcttcctctgtctgtgactttacacacagttgttcaaagttgttaaatgtcaagagtcaatcacatccctaggacatacctcccaactctcctgactcttatgttattgaaaaaacaaacaaacaaaaactcctttatgatgatattcaacttgagtggggttttttttccactttggtcctggatataatgaaatgatacatattaggataaattttcactgtgtatagtagcaatacgaacacacatgccaatgtatcaacatatctacttggttacattttggtttatgataattaaccttgattcatgtattgggaagctacagggactacgtaatacctgcttatcacataggaaaattatgtccatgattctgagctcccttcttcaaaagtttcctcctgggtgttctatgttctctctttatcctgaaatacatttattaggttgtgaggtatgttgaagaagtagaagccaggggtatgctttcagcatttattgcaaccaaaagttaaccccatcacggttaacgagcatctttggtctcttgtggaatttgaactaaaactatgagccttattcaatatctataattctatgatttttttaaattatgggaaattaatgaaagatgtttacatgaataatgtttgcccttactgtgttatgaatgagttttttgtagtgtgtctgggtgcatgatgcaagagagtaggaaaaatgtttctgaaacaaaacttgacaaatatttgtaatgaaagtaaatttaaagattgctataattgcgctatagaaacaatgcaagtattaaacaaaatatacaatcatc

SEQ ID NO: 180780 - DNA, 1127 bp, Homo sapiens
  Payload ID: 15604
  Gene Symbol: SETD7
  Gene Name: SET domain containing (lysine methyltransferase) 7
  ENST ID: ENST00000406354
  CDS Start-End: 225-434
agccgccgggagcacccagagggacgggaggcagccgcgcagccccgagctgggcagtgtccccagccgccatggatagcgacgacgagatggtggaggaggcggtggaaggttattaccccaagaaaaagccagtagaataactactgccttcattttcacccacctctgcaaaatcagctcaccagaatgattgggaagacaccaataagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagtaagccgtgtgactgttcactctgctggaaagtaacatactgtgactcttcacaatgaagagtaaaatgtattctgtgttagaacttgggagctgtgaaacctgagagtcaccacagctgacaccaagagtttatgaggcatgccctctcactgttactcactattggcttagattgttggcccttgaatccgttattaattatttttcagcgttgttttggaaaggagtaattaatcatgattaaaacaaattgagacaaattggttttattgtatcactaataaaggcaaaatatattgcttttaattcttttggcacatagagggagatagtggaaattttcattgttgctattagttttatttcctgtttctcatatgtaaaaaccagtccagcaatttttaatttgggagagcttactgcactgttgttacttgattctacaattccactaactgctttttaaggtattttatggtttatattgtttaaattaaggtgattaaaattaacttacctttgagtatttgatagcattttatgatatttctggagtctattaaagtaaaaagatatggca

SEQ ID NO: 180781 - DNA, 1590 bp, Homo sapiens
  Payload ID: 15604
  Gene Symbol: SETD7
  Gene Name: SET domain containing (lysine methyltransferase) 7
  ENST ID: ENST00000404104
  CDS Start-End: 633-1040
cacggacagtgcacgacggactttcaagttgctcccggcacaacgggaggtcgggagctcggagcccctacgggcggtccaagtgtccgcgagaagcccgcagcgcccaggaccgcgttgagcgctcggggcgcgccaagccgcacctaagcaaaagagaaacgctgacgggccggaggcgggttggctgggacgcggaatacgcgcggccccggagcgcctttcgttttaaggagccttacttctggaaagggacagggaactgtcaatcagcgagggagggagcgcaccggcgctgggtgatgtcagcggatcagctgctcgataacaaagagagggtattacaggagaaagttgcagcagcggcagcggccaaggcggcacaccggagcctccgaggcgaggggcaagtgggcgaagggaggggggacgacggctgctgccgcagcagctgaaggccaaggaattgaaagggctgtagggggaggcagtgcgagccagccccgactgctcctcctcttcctcctcctcctccaaactcgcgagccccagagctcgctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagtaagccgtgtgactgttcactctgctggaaagtaacatactgtgactcttcacaatgaagagtaaaatgtattctgtgttagaacttgggagctgtgaaacctgagagtcaccacagctgacaccaagagtttatgaggcatgccctctcactgttactcactattggcttagattgttggcccttgaatccgttattaattatttttcagcgttgttttggaaaggagtaattaatcatgattaaaacaaattgagacaaattggttttattgtatcactaataaaggcaaaatatattgcttttaattcttttggcacatagagggagatagtggaaattttcattgttgctattagttttatttcctgtttctcatatgtaaaaaccagtccagcaatttttaatttgggagagcttactgcactgttgttacttgattctacaattccactaactgctttttaaggtattttatggtttatattgtttaaattaaggtgattaaaattaacttacctttgagtatttgatagcattttatgatatttctggagtctattaaagtaaaaagatatggcagaa

SEQ ID NO: 180782 - DNA, 1602 bp, Homo sapiens
  Payload ID: 15604
  Gene Symbol: SETD7
  Gene Name: SET domain containing (lysine methyltransferase) 7
  ENST ID: ENST00000506866
  CDS Start-End: 102-1190
ctccaaactcgcgagccccagagctcgctcagccgccgggagcacccagagggacgggaggcagccgcgcagccccgagctgggcagtgtccccagccgccatggatagcgacgacgagatggtggaggaggcggtggaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatgggagactgatcttcaaggggcagtataaagataacattcgtcatggagtgtgctggatatattacccagatggaggaagccttgtaggagaagtaaatgaagatggggagatgactggagagaagatagcctatgtgtaccctgatgagaggaccgcactttatgggaaatttattgatggagagatgatagaaggcaaactggctacccttatgtccactgaagaagggaggcctcactttgaactgatgcctggaaattcagtgtaccactttgataagtcgacttcatcttgcatttctaccaatgctcttcttccagatccttatgaatcagaaagggtttatgttgctgaatctcttatttccagtgctggagaaggacttttttcaaaggtagctgtgggacctaatactgttatgtctttttataatggagttcgaattacacaccaagaggttgacagcagggactgggcccttaatgggaacaccctctcccttgatgaagaaacggtcattgatgtgcctgagccctataaccacgtatccaagtactgtgcctccttgggacacaaggcaaatcactccttcactccaaactgcatctacgatattggccagaagaatcacctgggaacgtgtaaaagaagcagatttggggctccactcccaaagatcccacatctggatcaagcgccctgggtagaacacagaaaagctggcattcctctttatagtgcagcccaaggactgatgctcataatgatgttcgtgagtaattaagaaaagataaaagcgaatggaatgaactctgcctactgataatggcaattgtcagaacataggcttccctcaagaactcaaaatcgcactctgggagccattttaagatctgaaaagagatacctaataagttgtgccagagaaatcaataaataaagtcaccagaggggggaaaaagaccctcaaaccagcaggacttgattagataaaatatcttttaaaacaatcaggatatttggaattttcttcaggctaatatgggagataagggaagtgaagtgtgggtgtagataaaaccagactgaccacatgtggataaggatttcagctgggtgatgagtacgagttcatgatcttatatgtgtgtttttatatgtttttgaaatctccacaataaaaaattacaaaaaaa

SEQ ID NO: 180783 - DNA, 5281 bp, Homo sapiens
  Payload ID: 15604
  Gene Symbol: SETD7
  Gene Name: SET domain containing (lysine methyltransferase) 7
  ENST ID: ENST00000608958
  CDS Start-End: 308-448
atccgtcctagctcctggacgctggaccgctcctcaactccctgctcagggggagactagctcctcgtattatgttcagtctctacgtttctctacagaaagccctcccaagtcccacggcagctgggtcttcatctctccactgcacccagaatcacacgctgacccagataaagctcaatgcagtgaacactcttggtctggaggtccaacatcagggagttgccgggactggtttcagacacacggaggaggagacacacagagaaaaggaggcagtgatgtgaccacagaggcagagattgacatgatgcagccgcaagaggcagagttatgcaggcctcacgatgcaactgcttctggaaaatgcaactgcgtgcatggtgaatcttcagctgccagaacaatcacttctcctggagacagattcattatgaaaggactttaattctggtctgacagactgcttgacattggagtgaattctcaaggcttatcaaaatcatctcgtggaatgatgagttgacttgcacccactgaaacgggggcaaatctccttcaaaagatcatgccaaagactgtgtgggtaccggaaaggctgtgtggcagggaaaaggtttgctctaacctagaagcctgcaaggtcccctctgcacgcccaagcagcgggcccgagttcattatggccagcaaagccaactgacaccacaggaaacagagctcgtgggacaccccatgacacgaagttttcaacctcattgcttccccctgaagtcaagtttagtcacctgtgctgtgctggaccagccatgaaagtaatgagggaactggatcactccagggaagcccaggtggaataataggtgtcactcaaaagtacagctttcaacttaaaaaggaaggaaattctgatacatgctacgtggatgaacattgaaggcatgatgctaagtgaaataagccagtcacaaaacaacaaatattgtatgattccatttatatgcggtacttagactagtcacatttatagaaactgaaagtagaagggagggtggttgccaagggctaggggaaaaagggaatggagttagtgtgtaatggatgtatttcagttttgctagatgaaaaagttctggagattagttgaacaatgtgaatgtacttactactgagttgcagactgaaaaatggttagtatgggccaggcgcggtggctcacacctataatcccaacactttgggaggccaaggtgggcagatcacttgatgtcaggagttcaagaccagcctggccaacatggtgaaacccatctctactaaaaatacaaaaaaattagccacgcatggtggcgcatgcctgtaatcccagctacacaggaggctgaggcacgagaatcgcttgaacccaggaggcagaggttacagtgagccgagatcacgtcactgcactccagcctgggcaacagagatagactctgtctccaaaaaaaaaaaaaaaaaaaaagttaggatggtaaatttaatgttatgtatacttttccacaattgttaattaattttttaaagtgcagcttctgatggcacacgtatctctccctcttctttgtctccagaagatgagagggagcatgagacagcagataggatgcgtcatcttattgcatttatttctgtagaccatgcattgaggctgtctgaccttcaattattcattaaacaaatatttactgagttgagtacgtactacatgccaagcattgttctagaggctggagttacagcagtgaacagaaaaagatctccccagttccctagtcacagggatctcaccttctagcaggtggagaaaaacaataagtaaataagcaagtaagatatatggtatttatatggcaataagagctatggagaaaaataaagcaaagaaggaggaagaagaagagtgtttcagggttgtatttttaaataaggtggtcaggggagacctcactgagaggatggtatttgagtaagacttgaatgagattagggagttagctatttaggtatctgcaggaagagtgtttcagacaaaataaaaagtcagtgcaaaggccctgaggcagaaacatgaatggggtgtttaaggaaaagcaaaggggccattgtggctgaaaaggtaagcagcagcagagagacagtctaagaagaggttagaaacatcacagaagcagcccagatcatgaaggttgagacggagtctcgctctgtcacctaggctggagtgcagtggcacaatctcggctcactgcaacttctgcctcctgggttccagtgattcttctgctatacctcccgagtaactgggactacaggcacccaccaccatgcccagctaggttttattattattattagtagtagtagtagagacagcgtttcaccatgttggccaggctggtctcaaactcctaacctcaagtgatctgcccacctcagccttcaaaagtgctgggattacaggcgtgagccaccctgcctggccccattatttgtaagagtttgactcatactctgagacagtaactagaggaatgatatgatccaacttccatgttaaaaggatcaccaggggttggaggcgggggtgtcaagggcaggatcaggaagactagtaggactgcaatactccaggcaagagatgctgagagctcagcccaagcaggtagctatggaggtggtaagatgtgggcagattctgggtatattttgaagatagggccaacaggatttactgagagactggaggtaaggctccacagaaagagaaataagagaaacattaaagatgaccgtatcggtttcctggggctgctgtaacacatcaccacaaacttggcggcttaaaacaacagaaatttattctctcacagttctaaggccaggaagtctgagattaaggggttcttgcttccaggggctctagagcagcagtcctcatccttccggggccggttttgtggaagaccatgtttccacggacaggggcaggagtgccgggggagagaggcagcagggtggtgggtgtgtgtgtggatggtttcgggatgaaactgctccacctcagatcatcaaggattagttagattctcataagagcacgcaacctagatccctcacgtgtgtggttcacaatagggtttgcattcccatgagaatctaatggcactgctctgacaggaggtggagctcaggtggcaatgctcatggggccgctcacctcctgctgtgtggcccagttcccaacaggccatggaccagtaccatcgcagcccagaggttgcagacccctgctgtagaggatattctattccttgtctcttccagcttctggtggatccaggcgttccttggcttggggttacatgactctagtctctgccttctcctcttttctgtgtcacctgtcccttgtaaggacaactgtcattggatttaggacccacccagataatccaggatgattccaccatgaaatccttaacttcattaaatctgcaaagaccctttttctggcttacacaaaaatgcttctggttgttttaaaagataaaccagttttgtttaactttgtttactgcaggcactagaagtgcaattggccctcttgaaatttgggattatttaaaaataaaggctgggagcagtggcttatgcctgaaatcccagcactttgggaggccaaggcaagtgggtcacctgagatcaggagttcaagaccagccatggccaacatggcaaaacccagtctctactaaaaatacaaaaattagccagatgtggtggcagttgcctataatcccagctacttgggaagctgaggcaggagaattgcttgaacctgggaggcagaggttgcagtgagctgagatcgcaccattgcactccagcctgggtgacagtgagactccgtctcaaaaaaaaaagatcctttttccaaatcaggtcacattctcagggcctggcgttaggatgtggacatacctttttgtgagccatgattcaactcactacagtgactcttattttaatctgagcaactgtaaagatgaacttgccattaactgagatggagaagaatgccagtttgggagagaagtccaggagctcggtgctggacatgtcagggttgagatgcttgtctgacatccagtggagctgatgagtgggcagctgggtgaataagcctgaagcttgggacagaagtatgggttggagatggaaatacgaaggttcccagatgtggacagcatctaaagccacggacccatggtctcaaccaggggaggagtgtggacagaggagaaaaacatcagggactgagccctggggcacaccaggattcagaggacccagccaagagactgagaaggagcagccggggagagaggaggcaaaacagcagagtgtgaggtcctagaaggcaagggagggaactgctttaaggagaaaggagtgatcaactcacagtagcaaattttcagaactgggcattcaagtaaaagttgaaatttcctatgcagtttcctgtaacaagattgtgcacttttcatgtcactcccctcttatgatgtgggaaaggcagtgacatctgcttaaaatcatcactaatacccttatgttataatgaagcatattttcaaagcgtgtcgttaccatttttatcagcatagcttttccttggttccatgttctatgtctacaactcagaagggaaagaaaggcacatgtttcagccccacatggggtcaggagagactgttatgactgagtcctgagctgctgttgcctggagtcacaccattttcctaatttttagttcctgcggtaaaagtcttgtccttaacagcagcgggggctgtgtgaggaaaatcaatcagggaaactgttttaaaaggttttaaatgattaccagagcatagtataatcacttcaggaaccaagacaacaatttgacaagtgaaaaactccccaaattccactggcttgcctgaaagcctgttacaaaaaaacaaacatctgacaaatcaatcaatctagcttaaacatccaaacagagggctttgtcactgagtgagggagaagcagcatgagatgactgggtgggttttccaccaaatggacatccagaagagacaacttaaatcttgagctgtttgggaggtttttagtgaatgataatgaatggttaaattagagaactgagtgctaaatcctgaagaataaatatgttttgtggaaa

SEQ ID NO: 180784 - DNA, 492 bp, Homo sapiens
  Payload ID: 15604
  Gene Symbol: SETD7
  Gene Name: SET domain containing (lysine methyltransferase) 7
  ENST ID: ENST00000608795
  CDS Start-End: 211-492
atccgtcctagctcctggacgctggaccgctcctcaactccctgctcagggggagactagctcctcgtattatgttcagtctctacgtttctctacagaaagtctggaggtccaacatcagggagttgccgggactggtttcagacacacggaggaggagacacacagagaaaaggaggcagtgatgtgaccacagaggcagagattgacatgatgcagccgcaagggcacctggacgatgacggattaccgcacgggttctgcacagtcacctactcctccacagacagatttgaggggaactttgttcacggagaaaagaacggacgggggaagttcttcttctttgatggcagcaccctggaggggtattatgtggatgatgccttgcagggccagggagtttacacttacgaagatgggggagttctccagggcacgtatgtagacggagagctgaacggtccagcccaggaatatgacacagatggg

SEQ ID NO: 180785 - DNA, 3069 bp, Homo sapiens
  Payload ID: 15605
  Gene Symbol: SETD8
  Gene Name: SET domain containing (lysine methyltransferase) 8
  ENST ID: ENST00000330479
  CDS Start-End: 517-1485
agatccggtcggctcggagcccagggctccagccgggctactcacgctccggaggcggagcttcagcagcgggagggggaggaatctggggcctcccaatggcagctcgggtgtcttccatcgcagccattcaacgtctggcgacggtcaaatttaaacacccctcccacctcctccgccgggacctgtcgggaaagcgtttgcagttattgcggcggctggacacgccccgccgccgaagaggcgggagaagggcggggcctttctccgagttggcctatcactacgggcagcctgcggagaggcgggaggcggcgccaatcggggcgagcagctggagcccggcggagcagttggctgagttgttgcaacttttttcgaaagctgggtttcccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggc

SEQ ID NO: 180786 - DNA, 3140 bp, Homo sapiens
  Payload ID: 15605
  Gene Symbol: SETD8
  Gene Name: SET domain containing (lysine methyltransferase) 8
  Uniprot ID: Q9NQR1
  ENST ID: ENST00000402868
  CDS Start-End: 427-1485
agatccggtcggctcggagcccagggctccagccgggctactcacgctccggaggcggagcttcagcagcgggagggggaggaatctggggcctcccaatggcagctcgggtgtcttccatcgcagccattcaacgtctggcgacggtcaaatttaaacacccctcccacctcctccgccgggacctgtcgggaaagcgtttgcagttattgcggcggctggacacgccccgccgccgaagaggcgggagaagggcggggcctttctccgagttggcctatcactacgggcagcctgcggagaggcgggaggcggcgccaatcggggcgagcagctggagcccggcggagcagttggctgagttgttgcaacttttttcgaaagctgggtttcccgggagatcccaggcggtgacagagtggagccatggctagaggcaggaagatgtccaagccccgcgcggtggaggcggcggcggcggcggcggcggtggcagcgacggccccgggcccggagatggtggagcggaggggcccggggaggccccgcaccgacggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaaaaaaaccacagaaaacaactttacatgtatataggtcttgaagtgagtgaagtggctgcttttttttttttttttttttgcttttttttgctttttgtagaagagattgagaatggtactctaatcaaaaataaagttttgtagtgggaccagaaattacttacctgacatccacccccattccccctcatcctgctggggttgaaagttccagacctgctgtcgaggccttgtgtttgtcagacacccagtgtcctcctgcaaggacgcaactgtgagctgaggtgtgagcctaggagcccaggacccctgaccccggccgctgctgccagcctcagaaaggcacccaggtgtgcaggggagcacacagggcccggcagcccccaggaatcaaggatagggctaaggttttcaccttaactgtgaaggcaggaggaataggtgactgcttcctcccgcccttcacagaactgattctcacacactgtcccttcagtccagggggccggggctcaggagccatgacctggtgtctcctgcccaccctggtcccaggtaaatgtgaatggagacaggtatgagaggctgtcctcgtctttgattcccccccaaccccacctcgggcctcacgacggtgctacctaagaaagtcttccctcccaccccccgctagcctggtcagtggtcagcaaattggaagaggatccgatgggagtgtaaatgtgagacacaatgtcttgattatacctgtttgtggtttagctttgtatttaaacaaggaaataaacttgaaaattatttgtcatcataaaaatgaaacaaattaaaatatttattgccaggcaaggcca

SEQ ID NO: 180787 - DNA, 1774 bp, Homo sapiens
  Payload ID: 15605
  Gene Symbol: SETD8
  Gene Name: SET domain containing (lysine methyltransferase) 8
  ENST ID: ENST00000437519
  CDS Start-End: 34-309
ccgggagatcccaggcggtgacagagtggagccatggctagaggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaactgcacgacatcgacggcgtacctcacctcatcctcatcgcctcccgagacatcgcggctggggaggagctcctgtatgactatggggaccgcagcaaggcttccattgaagcccacccgtggctgaagcattaaccggtgggccccgtgccctccccgccccactttcccttcttcaaaggacaaagtgccctcaaagggaattgaattttttttttacacacttaatcttagcggattacttcagatgtttttaaaaagtatattaagatgccttttcactgtagtatttaaatatctgttacaggtttccaaggtggacttgaacagatggccttatattaccaaaacttttatattctagttgtttttgtactttttttgcatacaagccgaacgtttgtgcttcccgtgcatgcagtcaaagactcagcacaggttttagaggaaatagtcaaacatgaactaggaagccaggtgagtctcctttctccagtggaagagccgggaccttccccctgcacccccgacatccagggacggggtgtgaggaagacgctgcctcccaatggcctggacgggatgtttccaagctcttgttcccctaacgtctcaacaggcgctcactgaagtgtatgaatattttttaaaaaggtttttgcagtaagctagtcttcccctctgctttctcgaaagcttactgagccccgggccccaagcacgggccgggcatagatttcctcttccacaagctgccgcttttctgggcaccttgaagcatcagggcgtgaaatcaaactagatgtgggcagggagagggttgcttacctgccctgctggggcagggtttcctgaaactgggttaattctttatagaaatgtgaacactgaatttattttaaaaaataataataaaaatttaaaaaaattaaaaataaa

SEQ ID NO: 180788 - DNA, 901 bp, Homo sapiens
  Payload ID: 15605
  Gene Symbol: SETD8
  Gene Name: SET domain containing (lysine methyltransferase) 8
  ENST ID: ENST00000437502
  CDS Start-End: 5-901
ccgaatgcgctggctgtggctcctgctcttcccagattccccagtcaccctgagagaagtcctcccgtcgcagccctggaggctgcggggctgcagtgatttgagaggggagaacgtatttaccgggcagtcaaagatctattcctacatgagcccgaacaaatgctctggaatgcgtttcccccttcaggaagagaactcagttacacatcacgaagtcaaatgccaggggaaaccattagccggaatctacaggaaacgagaagagaaaagaaatgctgggaacgcagtacggagcgccatgaagtccgaggaacagaagatcaaagacgccaggaaaggtcccctggtaccttttccaaaccaaaaatctgaagcagcagaacctccaaaaactccaccctcatcttgtgattccaccaatgcagccatcgccaagcaagccctgaaaaagcccatcaagggcaaacaggccccccgaaaaaaagctcaaggaaaaacgcaacagaatcgcaaacttacggatttctaccctgtccgaaggagctccaggaagagcaaagccgagctgcagtctgaagaaaggaaaagaatagatgaattgattgaaagtgggaaggaagaaggaatgaagattgacctcatcgatggcaaaggcaggggtgtgattgccaccaagcagttctcccggggtgactttgtggtggaataccacggggacctcatcgagatcaccgacgccaagaaacgggaggctctgtacgcacaggacccttccacgggctgctacatgtactattttcagtatctgagcaaaacctactgcgtggatgcaactagagagacaaatcgcctaggaagactgatcaatcacagcaaatgtgggaactgccaaaccaaa

SEQ ID NO: 180789 - DNA, 6903 bp, Homo sapiens
  Payload ID: 15606
  Gene Symbol: SETD1A
  Gene Name: SET domain containing 1A
  Uniprot ID: O15047
  ENST ID: ENST00000262519
  CDS Start-End: 687-5810
atcctcagaattcctcgggtccctcgatactcggctgaaaattctcatcggactctgagaggagcgctgggctggaggcattttccccagggacagaagcgggctattctctcacttgggccagtaagaaaaatccaaaaaaagttgtcgactctgccagcagggattggctaacgggccgttattttcttgactccaccaaggcggatgaaggggaggctacggctgaggccgggaacagtggcgaatctgcagcctctcagaatttggcagtgcaaggaagggacggggaagagaagcaaagcggcgcgcatcctgtccagcgattcgccccgcccgcccggtgaatctgcgtctgcagaacgcgccactgaaggttccccagcgctggctggcctcctcccctccgccccgccccttttcctcagggactagtcgcagctttcgtcgccgccgattcgtcaaggtcccgggccgcagcatctagatcgtcgtggcgaagccgactctccgggggatgcggccaatctccaagctccctgggccgcaacttccgagcctcccagggcgccggccgaggcgaagccgctaccctcggccccgtgggtcccccggcagcgcctgtggcgaaagtgcgaatgcagaccctgtgcccgctgggcctcgcgcagtgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacacaagcttctccagcagccgacaagataccccatcttcctttggccagttcacacctcagtcctcccaaggaaccccctacacgtctcggggcagcaccccctactctcaggactctgcctactccagcagcaccacttcaacctccttcaagccccggcggtcagagaacagctaccaagatgccttttcccgccgccacttctctgcatcttcagcctccacaaccgcctccacggccatcgccgccaccactgcagccactgcctcatcctccgcctcttcctcctcattgtcctcgtcctcctcgtcatcctcttcctcctcgtcctctcagtttcgtagttctgatgcaaactacccagcgtattatgaaagctggaatcgctaccagcgccatacttcctacccaccacgccgggccacacgggaggaaccccctggagccccttttgctgaaaatacagctgagcgcttcccaccttcttacacctcctacctgccccccgagcccagccggcccaccgaccaggactaccggcctcctgcctcagaggctccacccccggagcctccagaacctggtggaggcgggggtggaggagggcccagccctgagagagaagaagttcggacttccccccgcccagcctcccctgcccgctctggctccccagccccggagaccaccaatgagagtgtgcccttcgcccagcacagcagcctggattcccgcatcgagatgctgctgaaggagcagcgctccaagttttccttcttggcctctgacacagaggaggaggaagagaacagcagcatggtccttggggccagagatacagggagtgaggtgccttctgggtcagggcatgggccctgcacaccccctccggccccagctaattttgaggatgtggcacctacagggagcggggagccaggggctacccgggagtctcccaaggcaaatggacagaaccaggcttctccatgctcttctggagacgacatggagatctccgacgacgaccggggtggctcaccccctccggccccgacgccccctcagcagcctccgccacctccccctcccccgccgcctcctcctccctacctggcgtcccttcctcttggttatcctccccaccaacctgcctacctcctcccacccagacctgatgggccgccgccccctgagtaccccccacctcctccaccacccccgcacatctatgactttgtgaactccttggagctcatggaccgacttggggctcagtggggagggatgcccatgtccttccagatgcagacccagatgttaactcggctccatcagctgcggcagggcaagggattgattgccgcctcagctggcccccccggtggggcctttggggaggccttcctcccgtttccacccccgcaggaggcagcctacggcttgccgtatgctctatatgcacaggggcaggagggcagaggggcatactcacgggaggcctaccacctgcccatgccaatggcagccgagcccctgccctcctcctcagtctcgggagaggaggcccggctgccacccagggaagaagcagagctggcagagggcaagaccctcccgacagcaggcaccgtgggccgtgtgctcgccatgctggtccaggagatgaagagcatcatgcagcgagacctcaaccgcaagatggtggagaacgtggccttcggagcctttgaccagtggtgggagagcaaggaggagaaggccaagccattccagaacgcggccaagcagcaagccaaggaggaggataaagagaagacgaagctgaaggagcctggcctgctgtccctcgtggactgggccaagagcgggggcactacgggcatcgaggctttcgcctttgggtcagggctgagaggggccctgcggctgccttcattcaaggtaaagcggaaagagccatcggaaatttccgaggccagtgaggaaaagaggcctcgtccctccactcctgctgaggaagatgaagacgaccctgaacaagagaaggaggctggagagccaggacgtccggggaccaagcccccgaagcgggacgaagagcgaggcaagacccagggcaagcaccgcaagtcctttgctctggacagcgaaggggaggaggcatcccaggagtcctcctcggagaaggatgaggaggatgacgaggaagatgaggaagatgaagatcgagaggaagctgtggataccacaaagaaggagacagaggtgtcggatggcgaggacgaggaaagcgattcgtcttccaaatgttctctgtatgctgactcagatggcgaaaatgacagcacatcagactccgagagcagcagctcttccagctcctcatcctcctcctcctcctcgtcctcatcctcctcgtcctcttcatcctctgagtcctcctctgaagatgaagaggaagaggagcggccagcagcccttccctcagcctccccgccccccagagaagtcccagtgcccacgccagcacctgtggaggtgccagtgccggaaagggttgcaggctccccagtcacacccctgcccgaacaggaggcgtctccagcaaggcctgcaggccccacggaggagtcaccccccagtgcgcctctgcgtcccccagaaccacctgctgggcccccggcccctgccccacgccccgatgagcgtccctcttctcccatccccctcctgcccccacccaagaaacgccggaaaactgtctccttctctgccatcgaggtggtgccagccccggagccccctccagccacaccgccgcaggccaagtttcccggcccagcctcccgcaaggctccccggggcgtggagcggaccatccgcaacctgcccctggaccacgcatctctggtcaagagttggcccgaggaggtgtcccgaggaggccggagccgggctggaggccgaggccgcctcaccgaggaagaggaggctgagccagggacagaggtggacctggcggtcctggccgacctggccctgacccctgcccggcgcgggctgcctgccctgcctgctgttgaagactcagaggccacagagacatcggacgaggccgagcgccctaggcccctgctcagccacatcctcctggagcacaactatgccctggccgtcaagcccacgccccctgcgccagccctgcggcccccggagccagtgcccgcacccgccgccctcttcagttccccagctgatgaggtcctggaggcccccgaggtggtggtggctgaggcggaggagcccaagccgcagcaactgcagcagcagcgggaggagggcgaagaggagggggaggaagagggggaggaagaggaggaggagtcctctgacagcagcagcagcagcgatggggagggcgccctccggaggcgcagcctccgctcccacgcccggcgccgccgccctccgcccccacccccgccgccaccgccccgcgcctacgagccacgcagtgagtttgaacagatgaccatcctgtatgacatttggaactcgggcctggactcagaggacatgagttacctgcggcttacgtacgagcggctgctgcagcagacaagcggggctgactggctcaacgacactcactgggtccatcacacaatcaccaacctgaccaccccaaaacgcaagcggcggccccaggatgggccccgggagcaccagacaggctcagcccgcagcgaaggctactaccccatcagcaagaaggagaaggacaagtacctggacgtgtgcccagtctcggcccggcagctggagggcgtggacactcaggggacgaaccgcgtgctgtccgagcgccggtccgagcagcggcggctgctgagcgccatcggtacctccgccatcatggacagtgacctgctgaaactcaaccagctcaagttccggaagaagaagctccgatttggccggagccggatccacgagtggggtctgtttgccatggaacccattgctgctgacgagatggtcatcgaatacgtgggtcagaacatccgtcagatggtggccgacatgcgggagaagcgctacgtgcaggagggcattggcagcagctacctgttccgggtggaccacgacaccatcatcgatgccaccaagtgtggcaacctggccagattcatcaaccactgctgcacgcctaactgctacgccaaggtcatcaccatcgagtcccagaagaagatcgtgatctactccaagcagcccattggcgtggacgaggagatcacctacgactacaagttcccactggaagacaacaagatcccgtgtctgtgtggcacagagagctgccggggctccctaaactgaggtggggcaggatgggtgcccacacccctatttattccccctggtgccctgagctcccagcacccccccagccttagtgggctcagcagggcccacatgcccccatctccaagcgtggggttgggggccccaagcccagcgagggagcctcagtccctggaggcagcttctgcctctcctgtcacccctgcccaccaccccctgattgtttttctttgcggagaagaagctgtaaatgttttgtagcagccagcagctgtttcctgtggaaacctggggtgccggcctgtacagattctgtcctggggggctacacagtcctcttgctttgtgttaatggggacttccccttacgccctgcgtgtacccctccccagtttaggggtctctggggcagtggccatgttctccccctgggggggctctgcacccccagtcctggggactccgtgcctggaaccctgcctcatctgttcctgccagaccctgagggtcacccttccaccctggtgtcactccccggctcagccaggccaggatggcggggtgggtcccttttgctgggctggactgtacatatgttaatagcgcaaacccgacgccacatttttataattgtgattaaactttattgtacaaaagtgtttggtcggtgtatttgggcaggagcgaggggttgggggtagagggcacggagggttgtgcaagttgaagagagggaaaagtgggtacctgaagtgtggggcaggtaaaggggccttcaggcaagagcccagacctgcagagacagtccgagactgtctcggaccccctgacaggctgcagcagccgcacccgcaccaggaataccccaccagtgcccgccagggtggtgccaaggtcaggcctccccttcctacaatcacagctgcagctggacctccggcctcctgggaagcccagcaggagggaaggcctgaggtcacactgtgggatgaggtcaccgctggctccacccacagccccagaccccttcagcccactctgcaagttcgagcttcatccccaccaagttctccgctggacccagatgccagtggagcacagagcggcc

SEQ ID NO: 180790 - DNA, 926 bp, Homo sapiens
  Payload ID: 15606
  Gene Symbol: SETD1A
  Gene Name: SET domain containing 1A
  ENST ID: ENST00000452917
  CDS Start-End: 186-926
caaggtcccgggccgcagcatctagatcgtcgtggcgaagccgactctccgggggatgcggccaatctccaagctccctgggccgcaacttccgagcctcccagggcgccggccgaggcgaagccgctaccctcggccccgtgggtcccccggcagcgcctgtggcgaaatgtaaatgagcaaagatggatcaggaaggtgggggagatgggcagaaggccccgagcttccagtggcggaactacaagctcatcgtggatcctgccttggaccctgccctgcgcaggccttctcagaaggtgtaccgctatgatggagtccacttcagtgtcaacgactcaaagtatataccagtcgaagacctccaagacccccgttgccatgtcaggtccaaaaacagagacttttccctcccagtccctaagtttaagctggacgagttctatattggacagattccactgaaggaagtgacttttgcaaggctgaatgacaacgtgcgggagaccttcctgaaggatatgtgccgtaagtacggtgaggtggaagaggtagagatcctccttcacccccgtacgcgcaagcacctgggcctggcccgtgtgctcttcaccagcactcggggcgccaaggaaacggtcaaaaacctccaccttacctccgtcatgggcaacatcatccatgcccagcttgacatcaaaggacaacaacgaatgaaatactatgaactaattgtcaatggctcctacacccctcagactgtgcccactgggggcaaggccctgagtgagaagttccaaggctcgggtgcagccactgagacggccgaatcccgccgccgctcttcctctgacacagctgcctacccagcaggcaccactgcggtgggcactcctggcaacggcaccccctgctcccaggacaca

SEQ ID NO: 180791 - DNA, 5772 bp, Homo sapiens
  Payload ID: 15607
  Gene Symbol: SETD1B
  Gene Name: SET domain containing 1B
  ENST ID: ENST00000267197
  CDS Start-End: 1-5772
atggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattggaggaggaacaggagagcaccgaggaggaagaggaggcggaggaggaggaggaggaggaagatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactag

SEQ ID NO: 180792 - DNA, 8185 bp, Homo sapiens
  Payload ID: 15607
  Gene Symbol: SETD1B
  Gene Name: SET domain containing 1B
  Uniprot ID: Q9UPS6
  ENST ID: ENST00000542440
  CDS Start-End: 69-5840
gggggacaccatgtactggctggcggcgcagggaggccggcgcccggcggggatgttgggttaacggcatggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggaggaacaggagagcaccgaggaggaagaggaggcggaggaggaggaggaggaggaagatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactaggccccggcaccagactcaaaggatgtcagccgtagccctgggactcccgagcgtggagcccctggccccggggcccggccccccgcgcccgcccccatttcaggtgctgtcctctacccagcggccattcagggcctggcgccccacactaccccctggagcccctggctccggcccctccgcgggaaagggcttctctgtcgttcagcccacgtctctctcattttaacaaacgcccctttcaggatttctgtttaactccagcatcagcttctctctctccgtctctcctcccctctctctcttctctgtctcttctctctcccaccatcaccctcggcctcttcctgtgaatgctgctacgttgttttgtcttctctatttttttcctcgttgtgagaaaagacatttaaccgttgaaatgtgaaggtggaatcagagaggggccccgcgggggtctgcagaggcctcagtgtggctgtgcgtggcccgtgtcctggaagccacccggacctggacgcagggccaggtgctgtgggaaggatggaggcccccacggccttgacctcagaacactacgccctgaaagcgcccctcactgcccgtgggcacagtgaggagaccccacacctttccccacccgagctgcagcctgttccttccccagaggcctggggcaccactgacccggtggaccctgatggagctaagctgtcccaggcaggggtctccgctctgggctttccctgccacctcacaccccagcaccccctaaaccttgggttcaatgtttactttctcattcggatgccagcaacgcgggagcctctcggaggccccagtgcaggtgaggggcgctgagaacgcgggcagccactctcttctgcccttgccttcgccctgggtgggacagggctcccaagggcaggcgggtcccccagtcccgccattacgggttgtcagaccgtctgcgtgtggcattttttggcttataagcttcacccactcacccccaacccacaccccacatccccctgccggcagcccctcaacctaagaaggccagagcatatttattttcggagggagcagattacttctcccagagaaaggaaaatcttggaaaagatttaaaaacacaaatctaagccttgacggtttttttttcccttttgacccccttcccatctcttcagaatttattcccatggcttttttttttcttgtgcgtgtataaaatcaaaaggaaggggaaaaaggtttttgaagttcagaaccaacttctgtatatagaggctgccgcaaaggactttctcttgggaacattgtttcttgtagaaacatgcgggaagacattttttgctcatttctttgtacttccaaaaaaaaaggaaaaaaaagacaaaagcaagtccccccgtaccccagaaagcagaggaggcgtgtaaataatttctggaaagtgactgttgtgacccggagtcctcatcaagatgagcgcgctccatgagggagctgctcccaccctgcggacgcaggcggccggagcctctggtatctcagcttgtgtcaagcttgttatcatgtaaattctgtacaaagaattgttatttttctcttttttgttgttggtggttttgttgtgtgttttttgttgttttttttttattcctttcccccaggccctctctatttgagactgtgcccgccggtttcaagatcaaggaaattggtggcaacaagacacagatggggtacctgggcacagcggcgaacttctcttccgtttgcggttttctgcctaattgtgcaactgaggaaataatttatttttcacatgaggaaatgcgtagcttgtagagacggctgattcaagttacatgtacagcctccaaagggctgtctccattctgtccccttcccataaaagaagtgggggtgttcgagaagaccagggaagggacccttgcctcacccctccccctggcctcaccttgctcccagccatcgtgcccagtgttaacctcggctggccttcactaaggggactagacctccctctccccaggagccccagccccagagtggtttgcaataatcaagatatgtgtcgagtcatttttctttcaactccctcatttttcattgaacaaatctctgcttttcaagagttgggggtttctgctattttttgctttctctccctccccctgcaaagatgagaaccaatgagttttagggatgtttgtgcgggtagactccatcatccatatgtaacttgttttgaagagaagtgtttccgttgtgtgtcttgatgtaaatatttgttcatatttttgtgaatt

SEQ ID NO: 180793 - DNA, 5969 bp, Homo sapiens
  Payload ID: 15607
  Gene Symbol: SETD1B
  Gene Name: SET domain containing 1B
  Uniprot ID: Q9UPS6
  ENST ID: ENST00000604567
  CDS Start-End: 69-5969
gggggacaccatgtactggctggcggcgcagggaggccggcgcccggcggggatgttgggttaacggcatggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggcgtcctcgtcctcatccgcgtcatcatcctcggggtcctcaaccacctcaccctcgtcctcggcctccgacaaggaggaggaacaggagagcaccgaggaggaagaggaggcggaggaggaggaggaggaggaagtccccaggagccagctctcctcctcctcaacctcatccacatcagataaggatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactag

SEQ ID NO: 180794 - DNA, 5901 bp, Homo sapiens
  Payload ID: 15607
  Gene Symbol: SETD1B
  Gene Name: SET domain containing 1B
  Uniprot ID: Q9UPS6
  ENST ID: ENST00000619791
  CDS Start-End: 1-5901
atggagaacagtcaccccccccaccaccaccaccagcagcccccgccgcagcccggcccttcgggcgagaggaggaaccaccattggagaagttacaagttgatgattgacccggctctgaaaaaggggcatcataaactgtaccgctacgatgggcagcatttcagcctggcgatgtccagcaaccgcccggtggaaattgtcgaagatccccgggtcgtcgggatctggaccaaaaacaaggagctggagctgtcggtgcccaaattcaagatcgatgagttctacgtgggcccggtgcctccgaagcaggtgacatttgccaagctgaatgataacatccgtgaaaacttcctgagggacatgtgcaagaagtatggggaggtggaggaggtggagattttgtacaaccccaagaccaagaagcacctgggcatcgccaaggtggtctttgccacggtccggggagccaaggatgccgttcagcacttgcacagcacttccgtcatgggcaacattatccacgtggagctggacaccaaaggggaaacccgaatgcggttctatgaactgttggtcactggccgatacaccccccagaccctcccagtgggcgagctggacgctgtctctccaatcgtgaatgagaccctgcagctgtcagatgccctgaagcgcctcaaggatggaggcctgtctgcaggctgtggctccggctcctcctctgtcacccccaatagcggtgggacacccttctcccaggacacagcttattccagctgccgcctggacacacccaactcctatggacagggcaccccgctcacaccgcgcctgggcacccctttctcacaggactccagctactccagccgccagcccacaccctcatacctcttcagccaggaccctgcagtgaccttcaaggcccggcgccacgagagcaagttcacggacgcctacaaccgccgccacgaacatcattatgtacacaattctcccgcggtcactgcggtggccggggccacagccgctttccggggttcctcggacctcccgttcggagcagtcggcggcactgggggcagcagcggtcccccgttcaaggctcaaccacaggattcagccacatttgcccacactccaccacccgcccaagcaacccctgctcctggattcaagtctgctttctctccgtatcagaccccagtggcccacttccctccacccccggaagagcccaccgccacagccgcttttggggcccgcgacagtggggagttccggagggcaccggcgcccccacccctgccacctgctgagcctctggccaaggagaagccaggcacgccacccggcccgccgccccccgacaccaacagcatggagctgggcggccggcccaccttcggctggagtcctgagccctgtgacagccctggcacgcccacgctggagtcgtcccctgcagggccagagaaaccccacgacagcctggactcgcgcatcgagatgctgctgaaggagcagcgcaccaagctgctcttcctgagggagccggactcggacaccgagctgcagatggagggcagccccatctcctcctcctcctcccagctctccccactggccccctttggcaccaactcccagccaggcttccggggccccacgcccccctcgtcacgcccctccagcaccggcctggaggatatcagcccaacacccctcccagactccgacgaggacgaggagctcgacctgggccttgggcctcggcctccacctgagccaggccccccggaccctgctgggcttctgagccagacagctgaggtggccttggacctggttggagacagaaccccgacctcagagaagatggatgagggccagcagtcctcaggcgaggacatggagatctcggatgacgagatgccctcggcccccatcaccagcgctgactgccccaagcccatggtggtgaccccaggagcggcagccgtggcagccccttctgtgctagccccaaccctgccgctgcccccgccacctggcttccccccgctgccccccccaccaccaccacccccaccgcagcctggcttccccatgcccccaccgctgcccccaccgccgcccccaccccctccagcccaccctgctgtgacagtgcccccaccacccttgccagcgccgcctggagtcccgcccccacccatcctgccaccactgcccccctttccgccgggcctgttccctgtgatgcaggtggacatgagccacgtgctgggtggccagtggggcggcatgcccatgtccttccagatgcaaacgcaggtgctcagccggctgatgacgggccagggcgcctgcccctacccgcccttcatggccgctgcggccgccgctgcctcagctgggctccagtttgtcaacctgccgccctaccggggccccttctccctgagcaactccggcccaggccgcgggcagcactggccaccactgcccaagtttgacccgtcagtgcctccaccaggctacatgccacgccaggaggacccacacaaagccacggtggatggcgtcctgctggtggtcctcaaagaactcaaggccatcatgaagcgtgacctgaaccgcaagatggtggaagtggtggctttccgggcctttgacgagtggtgggacaagaaggagcggatggccaaggcctcgctgaccccggtgaagtcgggcgagcacaaggacgaggacaggccgaagcccaaggaccgcatcgcctcgtgcctgctggagtcatggggcaagggcgagggcctgggctacgagggcctgggcctgggcattgggctgcgtggggccattcgcctgccctccttcaaggtcaagaggaaggagccaccagacaccacctcatctggcgaccagaagcggctgcggccctcgacctctgtggatgaggaagatgaagagtccgagcgagagcgagaccgggatatggcagacaccccctgtgagctcgccaagcgggaccccaagggcgtgggtgtgcggcggcggccggcgcggcctctggagctggacagtggtggggaggaggacgagaaggagtcattgtcggcgtcctcgtcctcatccgcgtcatcatcctcggggtcctcaaccacctcaccctcgtcctcggcctccgacaaggaggaggaacaggagagcaccgaggaggaagaggaggcggaggaggaggaggaggaggaagtccccaggagccagctctcctcctcctcaacctcatccacatcagataaggatgacgacgatgacgacagtgatgaccgggacgagtctgagaacgatgacgaggacacagccctgtcagaggcgagtgagaaggacgaaggggactcggatgaagaggagacagtgagcattgtaacctccaaggccgaagccacgtcgtccagtgagagttccgagtcttctgagtttgagtcaagctccgagtcctcgccctcatcctcggaggatgaggaggaggtagtggccagggaagaggaggaagaagaggaggaggaggagatggtggccgaggaaagcatggcttctgcaggccctgaggactttgagcaggacggggaggaagcggctctggccccgggggcacctgcagtggactcgttgggcatggaagaggaggtggacatcgagactgaggctgtggcccctgaggagcggccctccatgctggacgagccccccttgcctgtgggtgttgaagagccagcggactccagggagccgcctgaggaaccaggcctgagccaggaaggggccatgttgctgtctccagagccccctgccaaggaggtggaggctcgacccccattgtcccctgagcgagctccagaacatgacctggaagtggagccggagccccctatgatgctccccttgccgctgcaaccaccattgccgcccccacgaccaccccggccacccagcccaccgccggagcctgagaccacagatgcctcacacccatctgtccctccggagccccttgccgaggaccaccccccgcatactccaggcctctgtggcagcctggccaagtcgcagagcacagagacggtgccagccacaccaggcggggagcccccgctatcagggggcagcagtggcctgtccctgagctctccgcaagtgcccggcagccccttctcctacccagccccgtcccctagcttgagcagtgggggcctccctcggacacctggccgggacttcagcttcacacccaccttctccgagcccagcgggcccttgctcctgcccgtctgcccactccccactggccgacgcgatgaacgctccgggcccctggcctccccggtgctcctggagacgggcctgcccctccctctgccccttcccctgcccttgcccttggcattgcccgccgtcttgcgggcccaggctcgtgcgcccaccccgctgccacccctgctgcccgcccccctggcctcttgccctcccccaatgaagaggaagccgggccggccccggcgatccccaccatctatgctctccttggatgggcccttggtccgaccaccagcaggggccgcccttggaagggaactcctgctcctgccgggccagccacagacccccgtcttccccagcacccatgacccccggacggtgaccctggacttccggaacgcggggatcccagcccctccaccaccccttcccccccagccacccccacccccacctcccccacctgtagagcccaccaagctgccctttaaggagctagacaaccagtggccctccgaggccattcctccgggcccccgtgggcgcgatgaggtcactgaggaatacatggagttggccaagagccgggggccgtggcgccggccacctaagaagcgccatgaggacctggtgccacctgcgggctcgcccgaactctcgccaccccagcccctcttccggccccgctcggagtttgaggagatgaccatcctgtatgacatctggaacggtggcatcgatgaggaggacatccgcttcctgtgtgtcacctacgagcgactgctacagcaggacaatggcatggactggcttaacgacacgctctgggtctaccatccctccaccagcctctcttcagctaagaagaagaaacgggacgatggcatccgcgagcacgtgacgggctgtgcccgcagtgagggcttctacaccatcgacaagaaggacaagctcagatacctcaacagcagccgtgccagcaccgatgagccccccgcagacacccagggcatgagcatcccagcacagccccacgcctccacccgggcaggctcggagcggcgttcggagcagcgccgcctgctgtcctccttcactggcagctgtgacagtgacctgctcaagttcaaccagctcaagttccggaagaaaaagctcaagttctgcaagagccacattcacgactggggcttgttcgccatggagcccatcgcggctgacgagatggtcatcgagtacgtgggccagaatatccgtcaggtgatcgcagacatgcgggagaagcgttatgaggacgagggcatcgggagcagctacatgttccgggtggaccatgacaccatcatcgacgccaccaagtgcggcaacttcgcgcgcttcatcaaccacagctgcaaccccaactgctatgccaaggtgatcacggtggagtcacagaagaagatagtcatctactcgaagcagcacattaacgtcaatgaggagattacctatgactataagttccccatcgaggacgtcaagatcccctgcctctgtggctccgagaactgccgggggaccctcaactag

SEQ ID NO: 180795 - DNA, 8172 bp, Homo sapiens
  Payload ID: 15608
  Gene Symbol: SETD2
  Gene Name: SET domain containing 2
  ENST ID: ENST00000330022
  CDS Start-End: 1-4097
aatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaatgaagtatctttgggtactgtattagtccgttttcatgctgctgataaagacatacccgagactgggaagaaaaagaggtttaattggacttgcagttccacatggctggggaggcctcagaattgcggcaggaggcaaaaggcacttcttacatggtggtggcaagagaaaaagaggaagaagcaaaagtgaaaacccttgataaacccatcagatcttgtgtgacttaatcaccatcacaagaataacacgagaaaggccggcccccatgattcagttacctcctcaagttgagtttgggtggggaaacagccaaaccatatcagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattctaaagcaggctgccttgtggttttggccagccttgtgctatgttgataagattgatttactgcttaaaatcactttactttatccaatttttactgaactttttatgtaaaaaaataaaatcaattaaagaa

SEQ ID NO: 180796 - DNA, 8142 bp, Homo sapiens
  Payload ID: 15608
  Gene Symbol: SETD2
  Gene Name: SET domain containing 2
  Uniprot ID: Q9BYW2
  ENST ID: ENST00000409792
  CDS Start-End: 44-7738
gctgcggggagggggctcgcgtcgccgtctccagccgctcccgatgaagcagctgcagccgcagccgcctccgaagatgggggatttctacgacccggagcacccgacccctgaagaagaagaaaatgaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttt

SEQ ID NO: 180797 - DNA, 7555 bp, Homo sapiens
  Payload ID: 15608
  Gene Symbol: SETD2
  Gene Name: SET domain containing 2
  ENST ID: ENST00000431180
  CDS Start-End: 1-3871
ttcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaagcttctcagggcagcaaggagcttgttaacatcaccagctgaccatgtgtctccttttctcaactccatttccaacttcgtgctgaagaaaaacgagaacctagcgtgcattctgtgaagaaacaggaagatggttgggaagttggatgatgcatgaaaaatataataggaggtatatcgaattccaaagaaaagtcaaactgaaaaggaaaacacaacaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttttcctggtttttgtttggttttcgttttgcttttagcctctacatgctaggatcacaggaagactttgtaaggacagtttaagttctcctgcaaggtttaatttgttatcatgtaaatattctaaagcaggctgccttgtggttttggccagccttgtgctatgttgataagattgatttactgcttaaaatcactttactttatccaatttttactgaactttttatgtaaaaaaataaaatcaattaaagaacttggca

SEQ ID NO: 180798 - DNA, 7075 bp, Homo sapiens
  Payload ID: 15608
  Gene Symbol: SETD2
  Gene Name: SET domain containing 2
  ENST ID: ENST00000445387
  CDS Start-End: 1-5026
acgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatgaaaagaaagatttttcaaaaaacttagaaaaaaatgatatcaaagatagagggcctcttaaaaaaaggaggcaggaaatagagagtgattctgaaagtgatggtgagcttcaggacagaaagaaagttagagtggaggtagagcagggagagacatcagtgcccccaggttcagcactggttgggccctcctgtgtcatggatgacttcagggacccacagcgatggaaggaatgtgccaagcaagggaaaatgccatgttactttgatcttattgaagaaaatgtttatttaacagaaagaaagaagaataaatctcatcgagatattaagcgaatgcagtgtgagtgtacacctctttctaaagatgaaagagctcaaggtgaaatagcatgtggggaagattgtcttaatcgtcttctcatgattgaatgttcttctcggtgtccaaatggggattattgttccaatagacggtttcagagaaaacagcatgcagatgtggaagtcatactcacagaaaagaaaggctggggcttgagagctgccaaagaccttccttcgaacacctttgtcctagaatattgtggagaggtactcgatcataaagagtttaaagctcgagtgaaggagtatgcacgaaacaaaaacatccattactatttcatggccctgaagaatgatgagataatagatgccactcaaaaaggaaattgctctcgtttcatgaatcacagctgtgaaccaaattgtgaaacccaaaaatggactgtgaacggacaactgagggttgggttttttaccaccaaactggttccttcaggctcagagttaacgtttgactatcagttccagagatatggaaaagaagcccagaaatgtttctgcggatcagccaattgccggggttacctgggaggagaaaacagagtcagcatcagagcagcaggagggaaaatgaagaaggaacgatctcgtaagaaggattcagtggatggagagctagaagctctgatggaaaatggtgagggtctctctgataaaaaccaggtgctcagcttatcccggctaatggttagaattgaaactttggagcagaaacttacctgtctggaactcatacagaacacacactcacagtcctgcctgaagtcctttctggaacgtcatgggctgtctttgttgtggatctggatggcagagctaggtgacggccgggaaagtaaccagaagcttcaggaagagattataaagactttggaacacttgcccattcctactaaaaatatgttggaggaaagcaaagtacttccaattattcaacgctggtctcagactaagactgctgtccctccgttgagtgaaggagatgggtattctagtgagaatacatcgcgtgctcatacaccactcaacacacctgatccttccaccaagctgagcacagaagctgacacagacactcccaagaaactaatgtttcgcagactgaaaattataagtgaaaatagcatggacagtgcaatctctgatgcaaccagtgagctagaaggcaaggatggcaaagaggatcttgatcaattagaaaatgtccctgtagaggaagaggaagaattgcagtcacaacagctactcccacaacagctgcctgaatgcaaagttgatagtgaaaccaacatagaagctagtaagctacctacatctgaaccagaagctgacgctgaaatagagcccaaagagagcaacggcacaaaactagaagaacctattaatgaagaaacaccatcccaagatgaagaggagggtgtgtctgatgtggagagtgaaaggagccaagaacagccagataaaacagtggatataagtgatttggccaccaaactcctggacagttggaaagacctaaaggaggtatatcgaattccaaagaaaagtcaaactgaaaaggaaaacacaagaaatcagcctgaataaatggaatgacttgtctgcctcacatattctaaggtgcagagtcagaatatgaactgttgcaactgaacgaggaagggatgctgttggcttcagagatcaaacacctgccccgaagactcctaataggtcaagagagagagacccagacaagcaaactcaaaataaagagaaaaggaaacgaagaagctccctctcaccaccctcttctgcctatgagcggggaacaaaaaggccagatgacagatatgatacaccaacttctaaaaagaaagtacgaattaaagaccgcaataaactttctacagaggaacgccggaagttgtttgagcaagaggtggctcaacgggaggctcagaaacaacagcaacagatgcagaacctgggaatgacatcaccactgccctatgactctcttggttataatgccccgcatcatccctttgctggttacccaccaggttatcccatgcaggcctatgtggatcccagcaaccctaatgctggaaaggtgctcctgcccacacccagcatggacccagtgtgttctcctgctccttatgatcatgctcagcccttggtgggacattctacagaacccctttctgcccctccaccagtaccagtggtgccacatgtggcagctcctgtggaagtttccagttcccagtatgtggcccagagtgatggtgtagtacaccaagactccagcgttgctgtcttgccagtgccggcccccggcccagttcagggacagaattatagtgtttgggattcaaaccaacagtctgtcagtgtacagcagcagtactctcctgcacagtctcaagcaaccatatattatcaaggacagacatgtccaacagtctatggtgtgacatcaccttattcacagacaactccaccaattgtacagagttatgcccagccaagtcttcagtatatccaggggcaacagattttcacagctcatccacaaggagtggtggtacagccagccgcagcagtgactacaatagttgcaccagggcagcctcagcccttgcagccatctgaaatggttgtgacaaataatctcttggatctgccgcccccctctcctcccaaaccaaaaaccattgtcttacctcccaactggaagacagctcgagatccagaagggaagatttattactaccatgtgatcacaaggcagactcagtgggatcctcctacttgggaaagcccaggagatgatgccagccttgagcatgaagctgagatggacctgggaactccaacatatgatgaaaaccccatgaaggcctcgaaaaagcccaagacagcagaagcagacacctccagtgaactagcaaagaaaagcaaagaagtattcagaaaagagatgtcccagttcatcgtccagtgcctgaacccttaccggaaacctgactgcaaagtgggaagaattaccacaactgaagactttaaacatctggctcgcaagctgactcacggtgttatgaataaggagctgaagtactgtaagaatcctgaggacctggagtgcaatgagaatgtgaaacacaaaaccaaggagtacattaagaagtacatgcagaagtttggggctgtttacaaacccaaagaggacactgaattagagtgactgttgggccagggtgggaggatgggtggtcaggtaagacagactctagggagaggaaatcctgtgggcctttctgtcccacccctgtcagcactgtgctactgatgatacatcaccctggggaattcaaccctgcagatgtcaactgaaggccacaaaaatgaactccatctacaagtgattacctagttgtgagctgttggcatgtggttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattgaaaataatttgttttt

SEQ ID NO: 180799 - DNA, 4231 bp, Homo sapiens
  Payload ID: 15608
  Gene Symbol: SETD2
  Gene Name: SET domain containing 2
  ENST ID: ENST00000412450
  CDS Start-End: 211-4231
ggttaccgccgtgtccgcaccgacccggccatcccggggctcggcggtcctctcgggctcctcgtggctcgtccgggccccgctgctagccaaagggcagagtcggaggagctgccggtgccgggcccggcaagagggcgccggtgaggagaagaagaaaatgaggcaaagattgaaaatgtgcagaaaacaggtttcatcaaaggaccaatgttcaaaggtgttgcttctagtcgatttttgcccaaaggcaccaaaacaaaagttaatttggaagaacagggacgacagaaggtgtcattcagcttcagccttacaaagaaaactttgcagaataggtttctcactgcacttggcaatgaaaagcaaagtgatactccaaaccctccagctgtacctcttcaggtagactcgactcctaaaatgaaaatggaaattggtgataccttatctactgcagaagaatcttccccaccaaagtcaagggtggaattgggcaaaattcattttaagaaacatctgcttcatgtaacatccaggccactgctggctactaccacagcagtagcatctccacctactcatgcagcaccattaccagcagtgatagcagaatcaacaactgtagactcaccgccctcatctccgcctccaccgcctccacctgcccaagccacaacactctcatcaccagcaccagtaacagagccagtggccttgccacatacaccaataacagttctaatggcagcaccagtacccttaccagtagatgtagcagttagatctctgaaagaaccaccaattataattgtaccagaatctttagaagcagatactaagcaggacactatatctaatagtttagaagaacacgtaactcaaatattgaatgagcaagcagatatttcctcaaaaaaagaagattcccatattgggaaggatgaagaaattccagatagttctaagattagtctgagctgtaaaaaaacaggttctaagaagaaatcctcacaatctgaaggcatctttcttggttcagaatctgatgaagattctgtacggacttcttcaagtcaaagatcacatgatttaaaattttcagcaagcattgaaaaggaaagagattttaaaaagagctcagcacctttaaaaagtgaggatctagggaaaccttcacgatctaaaacagacagagatgataaatattttagctattcaaaacttgaaagagatactcggtatgtatcttcccgatgtagatcagaaagagagcgacggcggagcagatctcactctaggtctgagagaggctctagaactaatttatcctattccaggtcagaacgatctcattattatgactctgatcgtcgctaccataggagctccccttatcgagagaggacgcgctattctcggccatacacagataacagagcacgagagagttctgactcagaagaagagtataagaagacatactcaaggcgtacctcatctcattcctcttcttacagagacctaaggacatcatcctattctaaatctgatcgggactgtaaaactgagacctcttacttagagatggaaagaagaggcaagtattcttcaaaactagaaagagaatctaaaaggacttcagaaaatgaagcaattaaaagatgttgttctccccctaatgaactgggattccgacgagggtcatcatattctaagcatgacagtagtgcttcccgttataaatctaccctttcaaaacctatacccaagtctgataaatttaaaaattctttctgttgtacagaattaaatgaagaaatcaaacagtctcattcttttagtttacagacaccttgttcaaaaggtagtgaattaagaatgattaataaaaatcctgaaagagaaaaggctgggtctccagctccatcaaatcgattaaatgattcacctactttaaaaaagctagatgaattgcctatttttaagtccgaatttataacacatgatagccatgatagtattaaggaattagactctttatctaaagtgaagaatgatcaattaagaagtttttgtcccatagaattaaatataaatggatctcctggggcagaatctgatttggcaacattttgcacttctaaaactgatgctgttttaatgacttctgatgatagtgtgactggatcggaattatcccctttggtcaaagcatgcatgctttcatcaaatggatttcagaatattagtaggtgcaaagaaaaagacttggatgatacctgcatgctgcataagaagtcagaaagcccatttagagaaacagaacctctggtgtcaccacaccaagataaactcatgtctatgccagttatgactgtggattattccaaaacagtagttaaagaaccagttgatacgagggtttcttgctgcaaaaccaaagattcagacatatactgtactttgaacgatagcaacccttctttgtgtaactctgaagctgaaaatattgagccttcagttatgaagatttcttcaaatagctttatgaatgtgcatttggaatcaaaaccagttatatgtgatagtagaaatttgacagatcactcaaaatttgcatgtgaagaatataagcagagcatcggtagcactagttcagcttctgttaatcattttgatgatttatatcaacctattgggagttcaggtattgcttcatctcttcagagtcttccaccaggaataaaggtggacagtctaactctcttgaaatgcggagagaacacatctccagttctggatgcagtgctaaagagtaaaaaaagttcagagtttttaaagcatgcagggaaagaaacaatagtagaagtaggtagtgaccttcctgattcaggaaagggatttgcttccagggagaacaggcgtaataatgggttatctgggaaatgtttgcaagaggctcaagaagaagggaattccatattgcctgaaagaagaggaagaccagaaatctctttagatgaaagaggagaaggaggacatgtgcatacttctgatgactcagaagttgtattttcttcttgtgatttgaatttaaccatggaagacagtgatggtgtaacttatgcattaaagtgtgacagtagtggtcatgccccagaaattgtgtctacagttcatgaagattattctggctcttctgaaagttcaaatgatgaaagtgattcagaagatacagattcggatgatagcagtattccaagaaaccgtctccagtctgttgtggttgtgccaaagaattctactttgcccatggaagaaacaagtccttgttcttctcggagcagtcaaagttatagacactattctgaccattgggaagatgagagattggagtcaaggagacatttgtatgaggaaaaatttgaaagtatagcaagtaaagcctgtcctcaaactgataagtttttccttcataaaggaacagagaagaatccggaaatttcttttacacagtccagtagaaaacaaatagataatcgcctgcctgaactttctcatcctcagagtgatggggttgatagtacaagtcatacagatgtgaaatctgaccctctgggtcacccaaattcagaggaaaccgtgaaagccaaaataccttctaggcagcaagaagagctgccaatttattcttctgattttgaagatgtcccaaataagtcttggcaacagaccactttccaaaacaggccagatagtagactgggaaaaacagaattgagtttttcttcctcttgtgagataccacatgtggatggcttgcactcatcagaagagctcagaaacttaggttgggacttctctcaagaaaagccttctaccacgtatcagcaacctgacagtagctatggagcttgtggtggacacaagtatcagcaaaatgcagaacagtatggtgggacacgtgattactggcaaggcaatggttactgggatccaagatcaggtagacctcctggaactggggttgtgtatgatcgaactcaaggacaagtaccagattccctaacagatgatcgtgaagaagaggagaattgggatcaacaggatggatcccatttttcagaccagtccgataaatttcttctatcccttcagaaagacaaggggtcagtgcaagcacctgaaataagcagcaattccattaaggacactttagctgtgaatg

SEQ ID NO: 180800 - DNA, 2878 bp, Homo sapiens
  Payload ID: 15609
  Gene Symbol: SETD3
  Gene Name: SET domain containing 3
  Uniprot ID: Q86TU7
  ENST ID: ENST00000331768
  CDS Start-End: 161-1945
cgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaaccaattaacaaacaaccacaagaaagggagaagaggtgcctgtgggagattttgcagacctattgtgggtataggtattttcttcctggggaagaattcagttcccgtctcagctgtacttttgtgggcctgtcatcttgatgaccagaatgaaagcttgctctgcctcctgccagccagaattggtggcgggacttggggatacagcgtgaaggtggggaagttgcacagcagaaaacagaattgaagttgggaaactctagagtctgggcaaaatgtttggttttttctcttaaaaaaaataacaccccattaccaaaagaaaaggtaaggtggcaaccttatttttaatagtttgaaatgatgataatcctaattatataaaaatatatatataaacacacatatatatagtgatttctaaagatttgtttacttttgtgttttgttttactgtactaagaacttgtcctttctccttgaatcaaagtaggacatgcatcatcctcctaattttaaatgttggctctgattttaaagtggtgcatttgattccagccttggtaatggagagtttgcaaacacacagcggcccacagcttcacgtggtggtgtgcagtgtgaggcagctccttggctttcctggttttcacaacaagctagagattttcaaagctacacttttgagtaaaaacccttattaaaagaaaaacatgattaata

SEQ ID NO: 180801 - DNA, 1330 bp, Homo sapiens
  Payload ID: 15609
  Gene Symbol: SETD3
  Gene Name: SET domain containing 3
  Uniprot ID: Q86TU7
  ENST ID: ENST00000329331
  CDS Start-End: 70-960
ggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtga

SEQ ID NO: 180802 - DNA, 2191 bp, Homo sapiens
  Payload ID: 15609
  Gene Symbol: SETD3
  Gene Name: SET domain containing 3
  ENST ID: ENST00000357563
  CDS Start-End: 119-364
gtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctggtaacgacctcttcccctgtgttgtgttgaatctgggaggctgttgttgctaagctttgggagggggctgttattccacctacccatcgtactccccccgttgcctccctccaaaaggaacaaacaaaaccgaaccggccactcctccccaccgcccacagatagaagctggtatttttcttttactgcattgactaatactgaaaactgggagcttgaatcttataccattttcaaaagccacagtgaactacatgtgtttgctaagccataattccagcctcaacattcattttcttatcttattgtaccacagactaaaccaaagtttctttttacttattctctttaaaatgctcatttattggggaaaaaaaatcatatttctcattttcccttttgtgtcttcttttctttgctgacactctgtttccagttctgtacctttgattctttcttgtccccggtcccttcccctgatgggctgacgaatccctggccatgtttatgaacctgtgtttgttacttgctttccctggtgctgtggggcgggaggagggggctcatgccttgggctcctcgcccttgactgcaggagtcagctggcatcatcatacctgggaagcctggggaggaggaagttgtattattatggtcccccacagctgggaagaggtggaggcaggctctgtttctccacattcttcggattccgggcagcagcataggtgaagcgctctgtgctctgtgagagggttgtctgataaagatttcctgatattagtaggcagaaataagatacatttcagatcattttgaaatatcatactttatactagtatactgtttgattaggttttatgttcatcttttctctgtcagctttccttgttattagcagtattataaatagaataaagaaatgccgtgaatgattatttcacattgaattccctggaatggccagaacacacgtagtgtgcgccagacactgaagacagaatatcctagtgctaatttgggaaggtctagcaacaagtatgttcttgaatcttaaaagtatttaaattgtggcaagaaagaatagttccatttttataattacattttggccttaatttagatatggttaatttaattagtaatgaatactaaaacataatagcatgttttataacttattttcattaatgaatataattttacattttttgttttgtttttcttcagagttattttaaattgacggtaagcttgaaatttaagaaatcttcaaatagcttttaatatctgactgtagtgtttttcttcttctttttttgaatgagatcatttgttcccaaactcaattgattattagagttctttttaat

SEQ ID NO: 180803 - DNA, 1754 bp, Homo sapiens
  Payload ID: 15609
  Gene Symbol: SETD3
  Gene Name: SET domain containing 3
  ENST ID: ENST00000446066
  CDS Start-End: 83-328
gggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagatcactactggttacaacctggaagatgaccgctgtgagtgtgtggctctgcaggattttcgggctggagagcagatttacattttttatggcactcgatccaacgcagagtttgtgatccacagtggttttttctttgacaataactcacacgacagagtgaaaataaagcttggagtgagtaaaagtgacagactctacgccatgaaggccgaggtcttggctcgtgccggcatccccacttccagtgtttttgcattgcattttaccgagccgcccatctctgctcagcttttggcttttctccgagtattctgtatgactgaagaagaactgaaagaacacttgctgggagacagcgctattgatagaatcttcaccttggggaactcggaatttcctgttagctgggacaacgaggtcaaactttggacatttcttgaagatagagcctcacttcttttaaaaacatataaaacaactattgaggaagataaatccgtcttgaaaaaccacgatctttctgttcgtgcaaaaatggccatcaaattgcgcttaggtgagaaagagattttggaaaaagcagtaaagagtgcagctgtcaaccgggaatactatcgccaacagatggaggaaaaggctccgcttcccaaatatgaagagagtaaccttgggctgttggagagcagcgtgggggactcgaggctccccctggtcttgagaaacctcgaggaggaggctggagtgcaggatgccttgaacatcagagaggcaatcagcaaagcaaaggccacagaaaacgggcttgtaaacggtgaaaactctatccctaatgggaccaggtccgaaaatgaaagtctcaatcaagaaagtaaaagagcagttgaagacgccaaaggatcttcttcagacagcactgctggagttaaggagtagctcgaggtgaagctggatgggggatccagtggagcaggagttgacggacagtccgttcacatcgctgtgtttccttgttaacatttttctttctgcagagaggaagatatgtttttgctgctttatataaaaatggtttttttaagttattttaaaaatctagcttccctttttgattaagattgccatcttgcttttaggcaaaacaaa

SEQ ID NO: 180804 - DNA, 973 bp, Homo sapiens
  Payload ID: 15609
  Gene Symbol: SETD3
  Gene Name: SET domain containing 3
  ENST ID: ENST00000453764
  CDS Start-End: 142-387
caggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgatcactactggttacaacctggaagatgaccgctgtgagtgtgtggctctgcaggattttcgggctggagagcagatttacattttttatggcactcgatccaacgcagagtttgtgatccacagtggtttt

SEQ ID NO: 180805 - DNA, 2592 bp, Homo sapiens
  Payload ID: 15609
  Gene Symbol: SETD3
  Gene Name: SET domain containing 3
  ENST ID: ENST00000436070
  CDS Start-End: 72-950
gaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggtctgtccgttacttttgatggaaaaagagaagattactttcctgatctaatgaaatgggcctctgaaaatggggcttctgtcgagggttttgaaatggttaacttcaaagaagagggctttggtttgagagcaacaagagatatcaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctggtaacgacctcttcccctgtgttgtgttgaatctgggaggctgttgttgctaagctttgggagggggctgttattccacctacccatcgtactccccccgttgcctccctccaaaaggaacaaacaaaaccgaaccggccactcctccccaccgcccacagatagaagctggtatttttcttttactgcattgactaatactgaaaactgggagcttgaatcttataccattttcaaaagccacagtgaactacatgtgtttgctaagccataattccagcctcaacattcattttcttatcttattgtaccacagactaaaccaaagtttctttttacttattctctttaaaatgctcatttattggggaaaaaaaatcatatttctcattttcccttttgtgtcttcttttctttgctgacactctgtttccagttctgtacctttgattctttcttgtccccggtcccttcccctgatgggctgacgaatccctggccatgtttatgaacctgtgtttgttacttgctttccctggtgctgtggggcgggaggagggggctcatgccttgggctcctcgcccttgactgcaggagtcagctggcatcatcatacctgggaagcctggggaggaggaagttgtattattatggtcccccacagctgggaagaggtggaggcaggctctgtttctccacattcttcggattccgggcagcagcataggtgaagcgctctgtgctctgtgagagggttgtctgataaagatttcctgatattagtaggcagaaataagatacatttcagatcattttgaaatatcatactttatactagtatactgtttgattaggttttatgttcatcttttctctgtcagctttccttgttattagcagtattataaatagaataaagaaatgccgtgaatgattatttcacattgaattccctggaatggccagaacacacgtagtgtgcgccagacactgaagacagaatatcctagtgctaatttgggaaggtctagcaacaagtatgttcttgaatcttaaaagtatttaaattgtggcaagaaagaatagttccatttttataattacattttggccttaatttagatatggttaatttaattagtaatgaatactaaaacataatagcatgttttataacttattttcattaatgaatataattttacattttttgttttgtttttcttcagagttattttaaattgacggtaagcttgaaatttaagaaatcttcaaatagcttttaatatctgactgtagtgtttttcttcttctttttttgaatgagatcatttgttcccaaactcaattgattattagagttctttttaataaaattaaagcaataatgcttggctttactctaaacaaacaaaaagaattaacccaggaacctctgtagcaaggtgagcagtgccctacccccagccccacagtccacctgatggtgttgaggccgccaccaggccaccgtggtccctagcgaagcttccatccattggcacctcacacactcatctgcacattggtttttgtttagcttccatgtaaatgggataaaacaattcctttttccctaccaagtgttaaaaaaaaaagaggtttatctcaaaataaagaaattgatgacaa

SEQ ID NO: 180806 - DNA, 1281 bp, Homo sapiens
  Payload ID: 15609
  Gene Symbol: SETD3
  Gene Name: SET domain containing 3
  ENST ID: ENST00000630307
  CDS Start-End: 171-416
agcgttgggccgcggtcgcggggccgtctcaggctgccgtcccgcccctcccgtccggccgccgccgccgccaccgccgccaccgcctgggggttggttgaggcggacggcggggtccgggccggagtacgtcgttcccgctgcgctaggggaagcgggcagtcagaaaaatgggtaagaagagtcgagtaaaaactcagaaatctggcactggtgctacagcaactgtgtcaccaaaggaaatcttgaacctgaccagtgagctgctgcagaaatgcagcagtccggcgcctggcccaggaaaagagtgggaagagtatgtgcagatccggactctggttgagaaaatacggaaaaagcaaaaaggcagaagaattgtttttatgggttccacgaaaattgctaatgactgttgaatctgctaaaaattcagtgttggggcccttatattctcaagaccgaatccttcaagccatgggaaacatcgcactggcctttcatttgctgtgtgagcgagccagccctaactccttctggcagccctatattcaaaccctccccagtgaatatgacactcctctctactttgaagaagatgaagttcggtatcttcagtccacacaagctatacatgatgtcttcagccagtataaaaacacagctcgacagtacgcctacttctataaagtcatccagacccatcctcatgccaacaaactacccttgaaggattctttcacttacgaggactacaggtgggcagtctcttctgttatgacgaggcaaaaccaaattcccacagaggatggttcccgcgtgaccctggctctgattcctttatgggatatgtgtaaccacaccaacggcctgacaccagaagattccttcgctcttgctgtcgcctctgcctaagaccctccattccttaggcacttacgggactcactcatagacctcctccagcgtggctgccctgagcaccctatgtggaatgactacgcctccagctcatccgccctcctgccctgtcctgttacatttccctctattgtccagatccgcttgtttctgcctttttaaaaaattattgttggttcacccccccgcctcccattagaatggaagatccatgaacgcagggtgattttgggggagggtctgttttgctcattgctatatcgctgtggtttttaatgaattcatgaccggtaaataaatgactgtaaaagccccatgcctaggaaaaaagatcagaaagaaataaaccaaaatgttaacgtg

SEQ ID NO: 180807 - DNA, 3015 bp, Homo sapiens
  Payload ID: 15610
  Gene Symbol: SETD4
  Gene Name: SET domain containing 4
  Uniprot ID: Q9NVD3
  ENST ID: ENST00000332131
  CDS Start-End: 241-1563
gcccgcggcggaaggggcggacccgggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctgaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 180808 - DNA, 1212 bp, Homo sapiens
  Payload ID: 15610
  Gene Symbol: SETD4
  Gene Name: SET domain containing 4
  ENST ID: ENST00000399201
  CDS Start-End: 288-1139
gacagagggcttcaggcacgcggctgctgctgccactgctgctctgagacaaggtggatgagtctgctgccggatcaagaaaaagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 180809 - DNA, 1208 bp, Homo sapiens
  Payload ID: 15610
  Gene Symbol: SETD4
  Gene Name: SET domain containing 4
  ENST ID: ENST00000399205
  CDS Start-End: 284-1135
gttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 180810 - DNA, 1160 bp, Homo sapiens
  Payload ID: 15610
  Gene Symbol: SETD4
  Gene Name: SET domain containing 4
  Uniprot ID: Q9NVD3
  ENST ID: ENST00000399207
  CDS Start-End: 176-1099
gaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaa

SEQ ID NO: 180811 - DNA, 1165 bp, Homo sapiens
  Payload ID: 15610
  Gene Symbol: SETD4
  Gene Name: SET domain containing 4
  Uniprot ID: Q9NVD3
  ENST ID: ENST00000399208
  CDS Start-End: 169-1092
gcggccgccggcgcctaggtgagctagtaggacttccgggtcgggcctccagttgcccgggtaacgggagcagagtcggcgggattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagaggttggaatcaactttgttcttaacattaacactatataatttttttccccatttggagatgtgtattttcagttttaataaaaatatcaaaacctt

SEQ ID NO: 180812 - DNA, 3258 bp, Homo sapiens
  Payload ID: 15610
  Gene Symbol: SETD4
  Gene Name: SET domain containing 4
  Uniprot ID: Q9NVD3
  ENST ID: ENST00000399212
  CDS Start-End: 432-1682
gggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctggtgggtgttagtcacacattttagactaaggtttgatggactaaatttatatagtttagagtcgatgagttgtgtctactcaacaattaggaacttaatccttttccttttgcttttcctacagaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 180813 - DNA, 4272 bp, Homo sapiens
  Payload ID: 15610
  Gene Symbol: SETD4
  Gene Name: SET domain containing 4
  Uniprot ID: Q9NVD3
  ENST ID: ENST00000399215
  CDS Start-End: 1374-2696
ttcatcagcgtaaaaagaactgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtaggacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttcccggcgcggtctgtggactgagcgctgggacccgcaccgaaccagccgccgttcgcctctggagctggacatgccgactttcgttaggtcaaataatgaaccttatactgcggaagtgcggtattaatattgcctggagttcttgtctcttgctcatttctgccctcgtatgttttagaagtagatttattttttatttttatttttttaatttattttttgtgacagagtctcgctctgtcgcccaggttggagtgcagtggcgtgatctcgtctagctgcagcttccgcctcctgagatcaagcgattctcctgcctcagcctccccagtagctggtattacaggtgcctgccaccacgcccggctgatttttgtatttttagtagagacggggtttcaccatgttggccaggctggtcttgaactcctgacctcagcccgcctcgggctcccaaagtgctggttttacaggcgtgagccactgtacccagccattattttatttttatttatgtatttatttttttatttttttgagacggagcctcgctctgtcgcccaggctggagtgcagtagcgcgatctcggctcactgcaacctccgcctcccaggttcaagcgattctcctgcctcagcctcccaagtagctgggattacaggcgtgtgccaccacgcctagctattttttgtatttttagtagattaagctgtagtcactaggtctgcaagataaaactgttttagagggactgatataatgggaattctgttactgtagggatcatgatttagctcacagtataaacgtttcatgtacaaaagcacttgagagaaacagtttaccaaaacatacatttgtatacttaaaggtacaaagaacagtgattatcatataactggaaagtaaatcaaagaaatgttttttattttagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacctggacctgctgaatcatagcccacatgtccaggtaaaagcagcgtttaatgaagaaactcattcttacgaaattagaacgacttcacgttggagaaagcatgaagaggtattcatctgttacggccctcacgataatcaacggctgttcctggaatacggatttgtttctgtccataatcctcatgcttgtgtttatgtctcaagagaaatacttgttaaatatcttccatcaacagataaacagatggacaaaaagatttctattttaaaggatcatggctatatagaaaatttgacatttggatgggatggaccatcttggaggctactcacagcccttaagttgttatgtctggaagctgagaaatttacatgctggaaaaaagtacttcttggggaggtaatttcagatacgaatgagaagacaagtttggacatagcccagaaaatatgctattatttcatagaagagactaatgctgtgcttcaaaaggtgtctcatatgaaggatgaaaaagaggccctgataaaccaactaactttggtggaatccttgtggacggaagagctaaagattctcagggcatctgccgagaccctgcacagtttgcaaacagcttttacctgatttcaccgaagcgcatttggtcacctcctctggtgggtgttagtcacacattttagactaaggtttgatggactaaatttatatagtttagagtcgatgagttgtgtctactcaacaattaggaacttaatccttttccttttgcttttcctacagaaacaaaagttaattttgaagagcatcatcatgggctggggtggtggctgcccccaggacatgcaggatttctgcagggggcagcacaggttctgggattgtgaggctgtgagtgaaggtggacaagctgtctggatggcaggtctaatgctcttccgaataaagtgctgaactgtgaggagagaggcggactgtgaggcagccaggagccagctgcgtccgtgtgtggtctgtcaccacggggcctgcttcttatctgacacagcagctatcagagtctagtggttgtgcttttaagatgctctgataccattgggttaaggggcagattggcggtgggtgtggggcagtgtgaggtagtcctggatccccgccagggtggcccagacgccagcccttccctgtgtggctgcactgaggtgggtgttgaagagccccctaggggacacacagcttccaggaggagggaatgtcctctaagcatgctcctggcctctcaaggtggcgcttgtctaattattcacttgggaagaatgactagctcagccagcggctctttctgctttgttctggcgactttcctgggcaggcctttccacctggggagctggctcatcctgcacagctgggccgtggtgggcctgtctgcttgattctggggttcagtgtaggtcagctgatggcgaaccatggtggtggtttggcttctgttcttattcttgagttttgataccacgcagaccttgggtggggagagcttcctgcacagctctcagcggcctgtggccttggaactgcctgcgtaagtaacggaggggctgctggtcctgttcaggcccgtgctggggacgccgcttagacaatgttgcccagagtcctgtttaccctcccagggttcattcttcccaagaactcaaattcctttctcattggagcctagtgaaaccaaatgaacgggacctgctggcctcaggaggcaggcagagtttaaaataaaactttctcatgatttcttgaacatctttccctgtttgtatatacactttgtgtttatttttcagtagctgcagtatattttttttcaatattcagtataatgcagtgtatttcatcatatgctgtatggagagtgggcagacttctgtggagggcccgatagtaaccatttgaagctttctggacctgtggtcttagtcccagcgattctgcagagcggccatcggcagcatgtcaaccatttgcatggctgggctccagggaaactactgacaacgacaggtggtgggccatagtttcctgacccctgtgctatgccagaatttctttttcctcttccctatgagtggacctaaatatgttaattccttttcacctttcaaaacggacagccccttgaacattaaaaacttcgcagacccta

SEQ ID NO: 180814 - DNA, 707 bp, Homo sapiens
  Payload ID: 15610
  Gene Symbol: SETD4
  Gene Name: SET domain containing 4
  ENST ID: ENST00000443703
  CDS Start-End: 507-707
ctgagtttaggtcgcaggtcccctccagggcaggcattatcgtgtgcgctgcagtaacctctcatcttgtggagtcctacacttagcgcatgttgctccggcgcgctgcgtaaagctgaggagcctgaggcccgaggtccgatgctcgcctggctggcctatggctgcgggagcggtgtgtgtcggaccgtaggacggcctcacggctagagtttgaggactatgggggcggggacggtgcctgtgtctgtggcggtcaccgggcttcacgtggtcctcagcagggtgatggtggacagctcgcgcgagggcccgggagtcttggggacacttcccggcgcggtctgtggactgagcgctgggacccgcaccgaaccagccgccgttcgcctctggagctggacatgccgactttcgttagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatcc

SEQ ID NO: 180815 - DNA, 431 bp, Homo sapiens
  Payload ID: 15610
  Gene Symbol: SETD4
  Gene Name: SET domain containing 4
  ENST ID: ENST00000442559
  CDS Start-End: 222-431
cgggagcagagtcggcgggaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggg

SEQ ID NO: 180816 - DNA, 745 bp, Homo sapiens
  Payload ID: 15610
  Gene Symbol: SETD4
  Gene Name: SET domain containing 4
  ENST ID: ENST00000429161
  CDS Start-End: 69-745
gttgcccgggtaacgggagcagagtcggcgggaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctg

SEQ ID NO: 180817 - DNA, 796 bp, Homo sapiens
  Payload ID: 15610
  Gene Symbol: SETD4
  Gene Name: SET domain containing 4
  ENST ID: ENST00000424303
  CDS Start-End: 103-796
cggccgccggcgcctagattgagcatttccacagaaattacagttttgtcctttttgaaaaaatagaactgtatttcagaaaaaagaaactacagttttagcatgcagaaaggaaaagggagaacaagccggatcagaagacgaaaactctgcggaagttctgaatcaagaggagtgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtgaaccttcttcccaaatctttaaaagcaaaggctgaagagcagagagcccacgtgcaggagttctttgcttcctccagagactttttctcttctctgcagcctctgtttgcggaggctgttgacagcatcttcagctacagtgccctgctgtgggcttggtgcaccgtcaacaccagagccgtgtacctgaggcccaggcagcgggaatgcctttctgcagagccggacacctgtgcactcgctccgtacc

SEQ ID NO: 180818 - DNA, 754 bp, Homo sapiens
  Payload ID: 15610
  Gene Symbol: SETD4
  Gene Name: SET domain containing 4
  ENST ID: ENST00000446166
  CDS Start-End: 383-754
gggagactgaggacttggattgcttaaggacaccaggcaggcgcgacagccttcagcctctccctctgcagttttggccggttcctttaacttgccttcatctggggctgtttggtatttccacgtgccttgggcccgcccactgcagcctccatcttggaagcggccgccggcgcctagaactgtatttcagaaaaaagaaactacagttttagcatgcagaaaggaaaagggagaacaagccggatcagaagacgaaaactctgcggaagttctgaatcaagaggagagatggggtctttctgtgttgggcaggctgggctcaaactcctggcctcaagcagtcctcccgccttggcctcccaaatgctgggaatacagaatgaatgagagccacaagtctgaatttatagagctgaggaagtggctgaaagctaggaagtttcaagattcaaacttagcgcctgcttgttttccaggtacaggaagagggctgatgagtcaaacatccctgcaggagggacagatgattatttcgttgcctgagagttgcctgctcaccacggacacagtgattcgaagctacttaggggcatacattactaagtggaagcctcctccatctcctctgctggcgctgtgcacctttttagtttcagaaaagcatgctgggcaccgatctctttggaagccttacctggagattttacccaaggcgtatacctgccctgtttgtttggagccggaagtggtg

SEQ ID NO: 180819 - DNA, 4786 bp, Homo sapiens
  Payload ID: 15611
  Gene Symbol: SETD5
  Gene Name: SET domain containing 5
  Uniprot ID: Q9C0A6
  ENST ID: ENST00000302463
  CDS Start-End: 365-4399
ggcagtaccagggattagggtctgggctggaaaaatcctggtgttttgaatatgttcaggtccagttcagactcttgatcccacagccacttcttgagtgagccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaaggcatttcgagagggatcccggaagtccttgcggatgaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaa

SEQ ID NO: 180820 - DNA, 3362 bp, Homo sapiens
  Payload ID: 15611
  Gene Symbol: SETD5
  Gene Name: SET domain containing 5
  ENST ID: ENST00000399686
  CDS Start-End: 1-2734
tgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagatatgtgactaagacagttgaaggagccactctagattggttggtcaagaaaagtctctgaggagttgacatttaaactgagacttcagtgacaaggaggcagtcctgggacgatgtgagtgaaattcattcttgaacgttgcagactctgtggtagaaaaagcttggttaagatgtaataaatggatggggctgggaaagaggatagaagatcctgtaagagggagataggggacagatcatgtagagcaggagtcggcaaactctttctataaagggccagatagtaaatatttagactttgcaagccatgtatggtctctgtcataactattcagccctttggctgggtgcgaatcatgcctgtaattccagcactttgggaggcccaagagagcagatcacttgaggtcagaagttcgagaccagcctggccaacatggcaaaaccctgtctactaaaaatacaaaaattaaccaggtgtggtggtgcgcacctgtaatcccagctactcaggaggctgaggcaggagaatctcttgaacctgggaggaggaggttatagtgaaccaaggtcactccactgcactccagcctgggtgatggagcgagactctgtctcaaaaaaaaaaaaaaaaaaa

SEQ ID NO: 180821 - DNA, 6582 bp, Homo sapiens
  Payload ID: 15611
  Gene Symbol: SETD5
  Gene Name: SET domain containing 5
  Uniprot ID: Q9C0A6
  ENST ID: ENST00000406341
  CDS Start-End: 191-4519
ctcgagtcctgccgcctcccgggagtgccgtgcgccgcagcccgggcccaggccccggcagcgcctgggacaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 180822 - DNA, 6463 bp, Homo sapiens
  Payload ID: 15611
  Gene Symbol: SETD5
  Gene Name: SET domain containing 5
  ENST ID: ENST00000407969
  CDS Start-End: 15-4400
ctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 180823 - DNA, 6827 bp, Homo sapiens
  Payload ID: 15611
  Gene Symbol: SETD5
  Gene Name: SET domain containing 5
  Uniprot ID: Q9C0A6
  ENST ID: ENST00000402198
  CDS Start-End: 436-4764
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctctggaacctaggccgagcatattgctgaggaacggggggtacaaggtgccagaggattgggtctggtggacaagaaacaagacttgtggtcacaattggcctctggccttggagaaagctgtaaatcttgtctgaagcagagactataaagaagtttctccctgctgtcaagggtacattgttgacaagcaaatggtgtttcggttagtaacggttctaagtgcaatgagttgtgttgaagcctccgtctcccatccttgcctgtagcccgtagtcacttgtgcagtgaggacatctttttaaatttaaaaaaaaaaaaaaaaaaagttttcaaaggaaaaaaagttaaaagagccaatctcaaagccccaagccatctgagtactgttagggttttatgcacttaagaaaaaaggtaggtatgtaaatgttcatcctaagacaaccattccaaaagcaggtatctggccaatgtgtgtccaccaagaatactgtttatctttgtcttaagatcaccaagaaataggcaaggatagtaaagcttggaacctgcaccaactggagggtgcctggctctttgaagaaaagctcatggtcagctcttgattattcgggagcagattatttgagtagattgtctgagcctccaactgttaccatcctactcccccttcccaagctatttcacagctcagtaacccatgaagtaagtagacaagaaaaggaggaatgagacatgatataggccaattgcattgctacttaccagcttttggcaataaatttcattaggaaggataccgagtggtttgggaatgcttcgaattttattttttctactcccaattaatcaggagttgatgatcccatgagcaggaccgcctccatgattggggagcatgcacttgtgactgcagggtaagagtgggaagataggtttgtggagtggcaccgacaggactgtgattgtgtgtgggcctgccccacatttctctgggggatgcttatgtgagagtgggcccagtgaaagagttaccaagccacccacacccctaacactgttctggatgagagatgagagcagaccggcttctccccatcagtgcattgtgcctgttgtacacccctggaggagccctggagccagcccaggtggggtacacaatctttttaaattccatatggttgccagcttatttctttcacttgtttactgtaatatctggcgtgtttttatttatctaattttgtattcagttataaccatggtaggggtagtgaatatatgacaggtgtaatccctggtgctgcagtggaccttcttttcttttggacaagataatactgtgagtttccctccttccttccctctaatttgttttccttttttccccagcctcttgcatccccttcttttctaccctgtcctacaactatcatatgcacagtcttctctctttgtgtgtgactgttacaaaatttcacttttcaaaatcgaaatcaggtgtttgctcaaatgaggggagattttttttttttttttttttttaaatgctgagacctcagcagagtacttttctttttgttgtttcccccacaaacccatcagtctgggagagcattgggagtggaaatcatgttgcctgggatgctggtttctttgtatattatataaaacgtatgtaaatgtctctccatttgggctggggtttgcattctccccttggctatttaaccaaggggagaggccagcgggcaggcggccctcaccctgcctggcacgtgcagagaccccagccactctgtgtgggcagggtgctgtcaagaccagacctcttgggggggtaggggcgggggggtggggggaactcttggaagggaagaagtatcacttctttctcaagtggagtgtttacaccttgctgtaacatttgaactttcacaagagatgtaataattttgataataaaattcttaaccataataatcataaagttgagaa

SEQ ID NO: 180824 - DNA, 3478 bp, Homo sapiens
  Payload ID: 15611
  Gene Symbol: SETD5
  Gene Name: SET domain containing 5
  ENST ID: ENST00000443339
  CDS Start-End: 255-413
ctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaaaaggaagtggaagccccctacctttcaagacgaagtggcactacaccaggatgtgaaagtccagcgaaagagacccaaggggcctagggggcagcacacccccagaagccaagtctattccaggcagtaccagggattagggtctgggctggaaaaatcctggtgttttgaatatgttcaggtccagttcagactcttgatcccacagccacttcttgagtgagccctgaatctgtggaggctagtccagcagttaatgagaagagcgtgtattccactcataattatgggaccactcagaggcatgggtgtcgaggactgccttatgctcatgacgaagttgccccttttgcacttccctgactccagcggacgtctagccctgcatcattgttcttgtttttatgtcccagttgaccttggcattttgttttatcactttcctggttgaagccaaaaaacaaagggatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagcaccggaagatcctgagggctgcaagagatttggctttggacactcttataatagagtatcgtgggaaagtcatgttacgacagcaatttgaggtcaatgggcatttcttcaaaaaaccatacccctttgtgctcttctactcaaaattcaatggtgtagagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgaggtgatttgggtttggttgctgggagtgctggatatgaaaatcatcatttgtaccttctcatttcaaatataataccattcc

SEQ ID NO: 180825 - DNA, 579 bp, Homo sapiens
  Payload ID: 15611
  Gene Symbol: SETD5
  Gene Name: SET domain containing 5
  ENST ID: ENST00000415650
  CDS Start-End: 282-479
aggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaggtatcctgtcttggtagtgaatggaagagggcctggtccctggggcagtgcagaaggcactttgatcatctcactcactgcaaatgtcatgtgaggtttcatggaagtattaagagatccaattaagaagaatagttctgagtctaaaccagcccagagtggcttctctaggggaaactccccgctcagctgccctgaatctgtggaggctagtccagcagttaat

SEQ ID NO: 180826 - DNA, 1824 bp, Homo sapiens
  Payload ID: 15611
  Gene Symbol: SETD5
  Gene Name: SET domain containing 5
  ENST ID: ENST00000431285
  CDS Start-End: 540-698
agtggcgtttccgctcgggcagcgggctgagtgagctgccgccgccgccgccgccgccgccgccgccgccgctgccgggggaggggcggccgccgcccgcctgcgctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaaaaggaagtggaagccccctacctttcaagacgaagtggcactacaccaggatgtgaaagtccagcgaaagagacccaaggggcctagggggcagcacacccccagaagccaagtctattccaggcagtaccagggattagggtctgggctggaaaaatcctggtgttttgaatatgttcaggtccagttcagactcttgatcccacagccacttcttgagtgagggtatcctgtcttggtagtgaatggaagagggcctggtccctggggcagtgcagaaggcactttgatcatctcactcactgcaaatgtcatgtgaggtttcatggaagtattaagagatccaattaagaagaatagttctgagtctaaaccagcccagagtggcttctctaggggaaactccccgctcagctgccctgaatctgtggaggctagtccagcagttaatgagaagagcgtgtattccactcataattatgggaccactcagaggcatgggtgtcgaggactgccttatgctgatcataattacggagcccctcctcctccgacacctcctgcttctccccctgtccagacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcag

SEQ ID NO: 180827 - DNA, 1323 bp, Homo sapiens
  Payload ID: 15611
  Gene Symbol: SETD5
  Gene Name: SET domain containing 5
  ENST ID: ENST00000421188
  CDS Start-End: 1-1323
caaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagaacatatcctcccctgagagttcccctgcgcataggcccgagtccctgtcacccgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactgg

SEQ ID NO: 180828 - DNA, 3428 bp, Homo sapiens
  Payload ID: 15611
  Gene Symbol: SETD5
  Gene Name: SET domain containing 5
  ENST ID: ENST00000413704
  CDS Start-End: 1-532
agagatgtgtgtggatgcccgtactttcggtaatgatgctcggttcatcagaagatcatgtacaccaaatgcagaggtgcgacacatgattgcagatgggatgattcacctgtgcatctatgctgtgtctgccatcaccaaggatgctgaggtcaccatagcatttgattatgagtatagtaactgtaattataaagtggactgtgcctgtcacaagggaaaccggaattgtcctatacaaaaaaggaatcctaatgctacagaactgccactcctaccacctcctccaagcctacccaccattggagcagagactagacgtagaaaagcacgacggaaagagctagagatggagcagcagaatgaggcttcagaggagaataatgaccagcaatcacaagaagttccagaaaaagtaactgtatccagtgatcatgagagcttgagtacagctgaatattgcctctatcttaaaggaagtagacaatccagaagaaaaaccagaagaagagaaagaagaggttatagatgaccaggagaacctagctcatagcaggaggaccagggaagatagaaaggtagaagccatcatgcatgcttttgaaaacttagagaaaagaaagaagcggcgggatcagcccttggaacagagcaactctgatgtagagattactacaaccacctcagagactcctgttggtgaagagacaaaaactgaagcccctgaatctgaagttagcaactctgtttcaaatgttaccatcccaagcaccccacagagtgttggtgtgaatacccggaggtcttcccaagcaggggatattgctgcagaaaaactagtccccaagccacctccagcaaagccttctaggccccggccgaagagtcgaatttctcggtacaggaccagttcagcccaaagactaaagcgtcagaagcaggccaatgcacagcaggcagaattgtcacaagctgccttggaagagggaggaagtaacagtttagtaactcctactgaagctggaagtctagacagttcaggagaaaacaggccattaacagggtctgacccaactgtggtgtcaattactggatcccatgtcaaccgtgctgcatctaaataccccaaaaccaaaaagtatctagttacagaatggttgaatgacaaagcagagaagcaagagtgccctgttgagtgccctttacgtatcacaacggatccaactgtactggcaacgaccctaaacatgttaccaggtcttatccattccccgttaatttgcaccacccccaaacactacattcgctttggctcaccctttatccctgagagacgtcgaaggccccttctgcctgatggcacattcagctcctgtaagaagcgctggataaaacaagccttagaagaagggatgactcaaacatcatctgtaccccaagagactagaactcagcacctataccaaagcaatgagaatagtagctcttctagtatctgcaaagacaatgcagacttgttgagcccattaaagaaatggaagtctcgctatctgatggagcagaatgtcaccaagttacttcggcctctgtctccagtcacaccaccccctcccaattcaggctcaaagagtccccagctggccacacctggctcatctcacccaggagaagaggagtgtcgaaatggatacagcctcatgttttcaccagtcacatctcttactactgctagtcgctgcaacactcctctacagtttgagctttgtcaccgaaaagacctggatttggcaaaagtaggataccttgactccaacactaacagctgtgctgatagaccttccctactcaactcaggtcattctgacctggctcctcatccctccctcggacccacttctgagactggtttcccaagcagaagtggagatggacatcagaccctcgtgagaaactcagaccaggcatttcggacagagttcaacttgatgtatgcctactcccctttgaatgctatgcctcgagcagatggactgtatcgaggatctcctctagtgggggataggaagcctttacatttggatgggggatattgttcccctgcagaaggattttccagcagatatgaacatggcttaatgaaagacctctctcgtggatccttgtcacctggtggtgaaagggcctgtgaaggagtcccatctgccccccagaacccaccacagaggaaaaaagtatccctgctggagtaccgaaaacggaaacaagaagctaaggaaaattctgctggtgggggaggtgactctgcacagagcaaaagcaagtctgcaggagctgggcaaggcagcagtaactccgtttccgacactggtgcccatggtgtgcagggatcctcagcccgaactccatcttcccctcacaaaaaattctccccatctcattcctctatgtcccatttggaggcggtaagcccatcagattccagaggcacttcttcatctcactgcagacctcaagagaatatcagcagtaggtggatggttcccacatcagtagaacgactccgagaaggagggagcatccccaaggtcctccgaagcagcgtgagggtggcccaaaagggagagccctctcccacatgggagagtaacatcacagagaaagactcagaccctgcagatggagaaggcccagagacattaagctcagcactctctaaaggagcaacagtttacagcccttccagatacagctaccagctcctgcagtgtgatagtcctcggacagaatcacaaagcctccttcagcagagttcctcccccttcagaggacatcctacacagtctccaggatacagttatcgaactactgcactgagacctggaaaccccccctctcacggttcttcagaatcatccctctcttccacgtcctattccagccccgcccaccctgtgtccacagactcgttggccccatttacggggacaccagggtattttagcagccagccacattctggaaacagcactggcagcaatcttccaaggaggagctgcccttctagtgctgctagccctaccctgcagggaccctcagactcgccaacctcagattcagtttctcagtccagcacaggaactctgagttccacctcctttcctcagaactctaggtcgtcattgccatcagacttacggactatcagtctgcccagtgctgggcagtcagctgtctaccaggcctccagggtatctgcggtttccaattcacagcactacccacaccgtgggagtgggggtgtgcaccagtaccgactccagccactgcaagggtcaggagtcaagactcagacgggactttcctagggcttctggatttgggcaaacagaactgaatgagcccatagctgcttccttccagctgcctct

SEQ ID NO: 180829 - DNA, 900 bp, Homo sapiens
  Payload ID: 15611
  Gene Symbol: SETD5
  Gene Name: SET domain containing 5
  ENST ID: ENST00000442373
  CDS Start-End: 390-900
acccccagaagccaagtctattccaggcagtaccagggattagggtctgggctggaaaaatcctggtgttttgaatatgttcaggtccagttcagactcttgatcccacagccacttcttgagtgagccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcaccttaactgttagaagaaccaaacccaagaagcggaaaaagagtccagaaaagggtcgtgcagcaccaaagacgaagaaaatcaagaattctccctctgaagcacagaatttagatgagaatacaactgagggctgggaaaatcggataagactatggactgaccagtatgaagaagctttcactaatcagtacagtgcagatgtacagaacgcgcttgaacaacacctacattctagcaaggaatttgtgggcaaacctactattttagacactattaataagactgaattggcctgtaataacacagttattggttcccaaatgcagttacagctgggaagagtcactcgtgttcaaaagc

SEQ ID NO: 180830 - DNA, 921 bp, Homo sapiens
  Payload ID: 15611
  Gene Symbol: SETD5
  Gene Name: SET domain containing 5
  ENST ID: ENST00000450326
  CDS Start-End: 436-921
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctgggacaaggtcttcagaactactagcagataatttggggggacttcatattcagaagtctatataaaggattcctcatgtccataacatgttggatgaggctctgcagctcacccccactctcagagtggtcagtctccattaattggaccccgtgatttccaatctctgctgtgttggacgtcatgagcattgcaatccctctgggagtcaccacatcagatacatcctactcagatatggctgctggatcagaccctgaatctgtggaggctagtccagcagttaatgagaagagcgtgtattccactcataattatgggaccactcagaggcatgggtgtcgaggactgccttatgctacgatcatccctcgttctgacctgaatggcctgccgtcgcctgtagaggaacgctgtggagacagcccgaactctgaaggagaaactgtacctacctggtgtccttgtggtctttctcaggatggcttccttctcaactgtgacaagtgcaggggaatgagcagggggaaggttattagacttcatcggcggaagcaggacaacatatcaggtggggatagcagtgcaacagaaagctgggatgaggagctttctccttccactgtgttgtatacagcaacacagcacacacctacaagcatcacctta

SEQ ID NO: 180831 - DNA, 1553 bp, Homo sapiens
  Payload ID: 15612
  Gene Symbol: SETD6
  Gene Name: SET domain containing 6
  Uniprot ID: Q8TBK2
  ENST ID: ENST00000219315
  CDS Start-End: 51-1472
ggaagtgaccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaa

SEQ ID NO: 180832 - DNA, 2042 bp, Homo sapiens
  Payload ID: 15612
  Gene Symbol: SETD6
  Gene Name: SET domain containing 6
  Uniprot ID: Q8TBK2
  ENST ID: ENST00000310682
  CDS Start-End: 60-1409
agagacgccggaagtgaccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaaaa

SEQ ID NO: 180833 - DNA, 3423 bp, Homo sapiens
  Payload ID: 15612
  Gene Symbol: SETD6
  Gene Name: SET domain containing 6
  ENST ID: ENST00000394266
  CDS Start-End: 57-1271
gacgccggaagtgaccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctgcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatcactcaaggaggacttcaattatttaattttgaactgttttgtcctctctggccataaaacttgacagtcatgaaaggtaaggcaaattttaagtgggttaagtttttaaatacgtatctactcattttctttaaaaaaaaaaaaaaaatacctgggggaaaaggatattaaaactgggtattttaaactcagcttaaccagataaacctgctccagcatttgtccagtgttgaaataaataggaagaaaaatacaatttccttaaacatgccagcttagtagtaggaatgacctatcaatcaatcaatcaatcattcagcaagaagttagttggtggttccccatggccccaaggtctgcagggctggattgtccacttttcctcctcaccaccagcactggctgctgctactgagaaaggcacagtggactcatgtgtgtgtcatgactttaatggttagctacagtatgcatacacatacaagaagtaggggagctgaagcccaggaaaaggctacaaaatacaacacagggaccaatacatttgcaaaacattcaaaatccttataaaaggggctgtattggtcctttcaactttgtcattattcagcttagcctgtatggccattcattcagtggggtaatgggggagaacaattaattaatgagatttggttccctttcctatattcccactgtttttaagtttcaggagaggattgggggggtgagggtaggggtgggctttaggcctggtctggtttccctttatataaagagctgacccccatctcaggcggctgaggtgtataatccccaaaagaaataagatggtacaaatgcagtcagctttggaatacgtttgggtagagacaaaatggaaactcatgggattccaatagtgagcccttcccatgttcctggacatatccaattctagcacatccacatttttaataacttagtgattttcaaggtcccctgtccacattaaaaaaataagttacataatattcaaactggctttttgctattctttgggacaccaggaatgtcagaagacatggagctatgccctcagacaagtgcatggcatcagctgcctcttcattacaaggtaccagtttatgtacttgccttggacacagcttgcacaaagccaagaagttccagacaaaggttttctctttcatgtatttacacaagttcaaaatgatattcacagcatcttctaaattttggccaagagtcaaaaaaatgcatttaaactttggaacgtgcccacataagacaggaggctgatcccaacagtagttggggcagatacccacaaaccaaagggctgggaaagtcaggaagagctgaaaggattcttcagtcagtttatgaactcggtgcagtgagacctctagactgacacgtacaacagagatgcagtttcgtctaactggcacctgtcccttccattacttgctgggcctgcttctgtcccatgcagcactgtgcgaccgactggaataacctgaaggatgaagacagttacaaatctctgattaaagagtaggcctaacaataccttgcatctcattcagctgacccaacctagagacagatggttttcagtctccagtctcattcctagacaattaaaaattactttgaactca

SEQ ID NO: 180834 - DNA, 576 bp, Homo sapiens
  Payload ID: 15612
  Gene Symbol: SETD6
  Gene Name: SET domain containing 6
  ENST ID: ENST00000447443
  CDS Start-End: 26-576
ccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctact

SEQ ID NO: 180835 - DNA, 1909 bp, Homo sapiens
  Payload ID: 15612
  Gene Symbol: SETD6
  Gene Name: SET domain containing 6
  ENST ID: ENST00000427443
  CDS Start-End: 43-831
ccgcgcggtgcgccggcccgcgaggaaacgcgctcttagaccatggcgacccaggcgaagcgtccacgggtggcggggcccgtggacggcggcgacctggatcctgtggcctgcttcctgagctggtgccggcgggtggggctggagctgagtcccaaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcggcatggccccagcttctccctttcacctcagaattgtcttcggatggtagccactcagcccattcctaaaggccatgagattttcaacacttatgggcaaatggctaactggcaactgattcatatgtacggttttgttgaaccatatcctgacaacacagatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaaccctaagacatca

SEQ ID NO: 180836 - DNA, 1739 bp, Homo sapiens
  Payload ID: 15612
  Gene Symbol: SETD6
  Gene Name: SET domain containing 6
  ENST ID: ENST00000422445
  CDS Start-End: 1-792
gtggcggggcccgtggacggcggcgacctggatcctgtggcctgcttcctgagctggtgccggcgggtggggctggagctgagtcccaaggtgagcgagcgagccggcgggcggaggacccgcggcggggcgcgggctgccctgaccagccctcctgctcaggtggcggtcagccggcagggcacggtggccggctacggcatggtggcccgggagagcgtgcaggccggagagctgttgttcgtggtgccgcgggccgcgctcctgtcgcagcacacctgctccatcggcggcctgctggagcgagagcgagttgcgctgcagagccagtcgggctgggtgccactgctgctggcgctgctccacgagctgcaggccccggcctcacgctggaggccctactttgcgctctggcccgagctgggccgcttggagcacccgatgttctggccagaggaggagcgccggtgcctgctccagggcacaggcgtacctgaggccgtggagaaggatttggccaacatccgcagcgagtaccagtccatcgtgctgcccttcatggaagcccaccccgatctcttcagcctcagggttcgctccctagaactctaccaccagctggtggcccttgtgatggcctatagctttcaggaaccactggaggaagaagaggatgaaaaggagcccaactcccccgtgatggtgcctgctgcagacatactaaaccacttagccaatcacaacgccaatctagaatactctgcgatgacacagctgacattcagatggtgacagttcgtgaggcagcattacagggaacaaaaactgaagctgaaaggcacctagtgtacgagcgctgggatttcctatgcaaactggagatggtaggggaagagggagcctttgtgatagggagggaggaggtgctgactgaagaggagctgaccaccacactaaaggtactgtgcatgcctgctgaggagttcagagagcttaaagaccaggatggagggggagatgataaaagggaagagggcagcctgacgatcacaaatattcccaagctcaaagcatcgtggagacagctgcttcaaaacagtgttctactgactttgcagacctatgccacagacttaaaaactgaccaaggtttactcagtaataaggaagtctatgcgaaactcagctggagggaacagcaagccttacaggttcgctatggtcagaagatgatcttacatcagttgttggagctgacaagttagcagtttccctgttccctgaaggaacagcaataagaactttattctaagctaatactcattgatgtttgaaaaagaggaaaatttggatctttcttttgcttactaaacaccaagaggaaaagtagcaaagttggtgtgctaggattaactcaggtaagggtgatgtgttttaggattgagaacagcagacttgggaatcactgctaattgttacttaaagcatgttacagatgttttgttctcagttttaaccaaagccagtggacatacggtagtaataagtaagtcttgttgtgtttcagcatttaataatagactttggaggtagacccctggtttaaatctaagtctagtttgaggaagtcacttaacctttattgaaaagactctggatttaataagctgtgtaactggtactcgatagttacccaaagttcagtctagatggcacaaaccacctctcagggaataaac

SEQ ID NO: 180837 - DNA, 1619 bp, Homo sapiens
  Payload ID: 15613
  Gene Symbol: SETD9
  Gene Name: SET domain containing 9
  Uniprot ID: Q8NE22
  ENST ID: ENST00000285947
  CDS Start-End: 387-1286
agacagccgtgacagagaaactaggcggtccgctcctgggacgcggtctcgggggcgggttcgcccctgaggcccggtgacccttcgcccgcaaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagagcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgtctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttataaaa

SEQ ID NO: 180838 - DNA, 1009 bp, Homo sapiens
  Payload ID: 15613
  Gene Symbol: SETD9
  Gene Name: SET domain containing 9
  ENST ID: ENST00000418299
  CDS Start-End: 32-151
gccgtcctggtcacggccccgcggggcagccatgcctggccgtctgctgcggggcctgtggcagcgatggcgccgttacaagtaccgcttcgttccctggatcgcactgaacctaagccacaacccgaggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaagcccacttcgatgtgttgttcttgtcgcacttagggacatcaatcaaggagaagagcttttttcaaactactacacaattgtcagctaactctgtgaatcagaaattattaggttttctactcagctattaattctaagtgttttttgttaatcacttctctgagttctacctgtaaaacaaatattttgagacttaattggaataggaatttcttatgtttttgttgatattatatttatgttccaatttcatgataaaagctacttgcttcattacaatttcaaatttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaactttatttttacagaattgagtaaaaaatacctattgtgttgccatgagtaaa

SEQ ID NO: 180839 - DNA, 417 bp, Homo sapiens
  Payload ID: 15613
  Gene Symbol: SETD9
  Gene Name: SET domain containing 9
  ENST ID: ENST00000423328
  CDS Start-End: 271-417
ttgcgttcggcactgactggggagcttgtatctgggcaaaaatggaaactttttaaaaagactgcccttaccgcgtgagagtgcgtggctttttctccaccaggggttaattaggtgcttgaacttcctcagaaaagccaagccagggtttattttcatagttcatacaagtacttcacgtggttaaagaagcccatcccggctgtgagaatagcgtgcagtagctcgcgcgttaagaacgggcagaacgccactcaaaagcacgtcgggatggtgggtttcggattggggaccctccgatatgttccagaggaatccaaagacaaagttatctcagatgaagatgtcctaggaacattactgaaagttttccaggctctattcttaaatgatttcaataaacaatcagaaatcttg

SEQ ID NO: 180840 - DNA, 1306 bp, Homo sapiens
  Payload ID: 15613
  Gene Symbol: SETD9
  Gene Name: SET domain containing 9
  Uniprot ID: Q8NE22
  ENST ID: ENST00000628593
  CDS Start-End: 295-1110
aaccagggctagcgcttgtgtgcgcccacggaagcacccgagcgaccggagaaagaaaaagtggtcaaggggacctccttccagctctacgcgcctctcattcagagaggtgaggtcaggaaaggggaaggacgaagccccagagcaacagaagtcaggcggtgccaggaacactgagagcggagccaggggaaggcggccgagcgcggccccctctcctcccgggccggggcgggcccgaggcctcgatccgccttccccgcgccgtcctggtcacggccccgcggggcagccatgcctggccgtctgctgcggggcctgtggcagcgatggcgccgttacaagtaccgcttcgttccctggatcgcactgaacctaagccacaacccgaggaccctccgatatgttccagaggaatccaaagacaaagttatctcagatgaagatgtcctaggaacattactgaaagttttccaggctctattcttaaatgatttcaataaacaatcagaaatcttgtctatgcttccagaatctgttaaatcaaaatatcaagacctactggcagttgaacatcaaggggtgaaactgcttgaaaacagacatcaacagcaaagtacctttaaaccagaagaaattctttacaagactttgggtttcagtgttgcccaagcaactagctcattgatttctgctggaaaaggtgtcttcgttactaaaggattggtaccaaaaggcgcagtcgtatctatgtatcctggtacagtatatcagaagtatgagccgatctttttccagtccattggaaatccgtttatttttagatgcctggatggggtactcattgatgggaatgacaaagggatatcaaaagttgtgtacagatcttgcaatgggagggatcgactcggccctttaaaaatgagtgatagtacatggctaacgtcagaaattcataaccctctggctgtgggacagtatgtcaacaattgttccaatgacagagcagctaatgtctgttatcaggaatttgatgtgcctgcagttttccctatagaactgaagcagtatcttccaaacattgcctacagctatgacaaacaaaggtgacatgactgtctacgtagaaaactccaaagaatcaacaaaaaatcgcctgtaactaataagcacttacagcaaagtttcaggagacaaggttaatacacaaaagtcaactgctttcctatataacagcaatgacgattgaaatttgaaatttaaaacacaagaccatttacattagcaccccaaaattaaaatactt

SEQ ID NO: 180841 - DNA, 4437 bp, Homo sapiens
  Payload ID: 15614
  Gene Symbol: SETDB1
  Gene Name: SET domain, bifurcated 1
  Uniprot ID: Q15047
  ENST ID: ENST00000271640
  CDS Start-End: 191-4066
ggcactaaaggtttgcttccgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaagaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaact

SEQ ID NO: 180842 - DNA, 1478 bp, Homo sapiens
  Payload ID: 15614
  Gene Symbol: SETDB1
  Gene Name: SET domain, bifurcated 1
  Uniprot ID: Q15047
  ENST ID: ENST00000368962
  CDS Start-End: 127-1320
gtttgcttccgggcgtttcttttgcttccccttccctctttcacgcttcctcccctccccctcctcccttatcccttcgctttcgctcttttccgtcgaggccgacccctgagttaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaa

SEQ ID NO: 180843 - DNA, 1045 bp, Homo sapiens
  Payload ID: 15614
  Gene Symbol: SETDB1
  Gene Name: SET domain, bifurcated 1
  ENST ID: ENST00000368963
  CDS Start-End: 106-855
ttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggt

SEQ ID NO: 180844 - DNA, 548 bp, Homo sapiens
  Payload ID: 15614
  Gene Symbol: SETDB1
  Gene Name: SET domain, bifurcated 1
  ENST ID: ENST00000368964
  CDS Start-End: 43-378
aaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggat

SEQ ID NO: 180845 - DNA, 4370 bp, Homo sapiens
  Payload ID: 15614
  Gene Symbol: SETDB1
  Gene Name: SET domain, bifurcated 1
  Uniprot ID: Q15047
  ENST ID: ENST00000368969
  CDS Start-End: 118-3990
ctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaaccacagttgcagccccaacctgtttgtccagaatgtcttcgtggatacccatgatcttcgcttcccctgggtggccttctttgccagcaaaatccgggctgggacagaacttacttgggactacaactacgaggtgggcagtgtggaaggcaaggagctactctgttgctgtggggccattgaatgcagaggacgtcttctttagaggacagccttcttcccaacccttcttgaactgtcgtttcctcaggaactgggtcttcctgattgttgaaccctgacccgaagtctctgggctagctactccccccagctcctagttgatagaaatgggggttctggaccagatgatcccttccaatgtggtgctagcaggcaggatcccttctccacctccaaaggccctaaagggtggggagagatcaccactctaacctcggcctgacatccctcccatcccatatttgtccaagtgttcctgcttctaacagactttgttcttagaatggagcctgtgtatctactatctccagtttgtattatttcttgaaagtcttttaacaatatgataaaactaagattgtg

SEQ ID NO: 180846 - DNA, 590 bp, Homo sapiens
  Payload ID: 15614
  Gene Symbol: SETDB1
  Gene Name: SET domain, bifurcated 1
  ENST ID: ENST00000423081
  CDS Start-End: 139-590
gaactgggtttgcgaatgggtaggacgcacccctagaatgggtagcacgggggtgggctggtgtgtgggcagaggaaaatggaggcgctgaaaatcagattttctttaaccgtttgattaaaaaagcagttcacacgaatgtgtgaagtatttggattgtggatattagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattc

SEQ ID NO: 180847 - DNA, 668 bp, Homo sapiens
  Payload ID: 15614
  Gene Symbol: SETDB1
  Gene Name: SET domain, bifurcated 1
  ENST ID: ENST00000448029
  CDS Start-End: 199-668
aaaggtttgcttccgggcgtttcttttgcttccccttccctctttcacgcttcctcccctccccctcctcccttatcccttcgctttcgctcttttccgtcgaggccgacccctgagttgtgagtctggggtctggttggtgaaaaagagcccttgaagctggaagacgggaggtgcggggaatactaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgcctt

SEQ ID NO: 180848 - DNA, 3854 bp, Homo sapiens
  Payload ID: 15614
  Gene Symbol: SETDB1
  Gene Name: SET domain, bifurcated 1
  ENST ID: ENST00000498193
  CDS Start-End: 76-3854
ttggtgaaaaagagcccttgaagctggaagacgggaggtgcggggaatactgttgagttatttgaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgacttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtccaagtgtgcctgccatcaactaactatccaggctacagcctgtaccccaggaggccaaatcaaccctaactctggctaccagtacaagagactagaagagtgtctacccacaggggtatatgagtgtaacaaacgctgcaaatgtgacccaaacatgtgcacaaaccggttggtgcaacatggactacaagttcggctacagctattcaagacacagaacaagggctggggtatccgctgcttggatgacattgccaaaggctcttttgtttgtatttatgcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggacactgacgaccgaaacaagatgtcagtagttactgaaagctctcgaaattacggttacaatccttctcctgtgaagcctgaaggacttcgccgcccacctagtaagactagtatgcatcaaagccgaagactcatggcttctgctcagtccaaccctgatgatgtcctgacactgtccagcagcacagaaagtgagggggaaagtgggaccagccgaaagcccactgctggtcagacttcggctacagcggttgacagtgatgatatccagaccatatcctctggctctgaaggggatgactttgaggacaagaagaacatgactggtccaatgaagcgtcaagtggcagtaaaatcaacccgaggctttgctcttaaatcaacccatgggattgcaattaaatcaaccaacatggcctctgtggacaagggggagagcgcacctgttcgtaagaacacacgccaattctatgatggcgaggagtcttgctacatcattgatgccaagcttgaaggcaacctgggccgctacctcaacgtgagacccctctccccacctctagatgctggattatcccatggtcctcagatttcttttaacatactctataagcccttttcttgttataaactcttgatctcaaagga

SEQ ID NO: 180849 - DNA, 587 bp, Homo sapiens
  Payload ID: 15614
  Gene Symbol: SETDB1
  Gene Name: SET domain, bifurcated 1
  ENST ID: ENST00000525956
  CDS Start-End: 98-587
agttttcgtcgcctctgaggggcgccccgcggctttggatttgaccccgtcaggctaccgtcgcggtgaccggaacggcactaaagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatg

SEQ ID NO: 180850 - DNA, 2043 bp, Homo sapiens
  Payload ID: 15614
  Gene Symbol: SETDB1
  Gene Name: SET domain, bifurcated 1
  ENST ID: ENST00000534805
  CDS Start-End: 135-2043
ttcctcccctccccctcctcccttatcccttcgctttcgctcttttccgtcgaggccgacccctgagttgtgagtctggggtctggttggtgaaaaagagcccttgaagctggaagacgggagaggacaaaagcatgtcttcccttcctgggtgcattggtttggatgcagcaacagctacagtggagtctgaagagattgcagagctgcaacaggcagtggttgaggaactgggtatctctatggaggaacttcggcatttcatcgatgaggaactggagaagatggattgtgtacagcaacgcaagaagcagctagcagagttagagacatgggtaatacagaaagaatctgaggtggctcacgttgaccaactctttgatgatgcatccagggcagtgactaattgtgagtctttggtgaaggacttctactccaagctgggactacaataccgggacagtagctctgaggacgaatcttcccggcctacagaaataattgagattcctgatgaagatgatgatgtcctcagtattgattcaggtgatgctgggagcagaactccaaaagaccagaagctccgtgaagctatggctgccttaagaaagtcagctcaagatgttcagaagttcatggatgctgtcaacaagaagagcagttcccaggatctgcataaaggaaccttgagtcagatgtctggagaactaagcaaagatggtgacctgatagtcagcatgcgaattctgggcaagaagagaactaagacttggcacaaaggcacccttattgccatccagacagttgggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtttctcattttctttgatgatggctatgcttcctatgtcacacagtcggaactgtatcccatttgccggccactgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggatgacaaaagatgtgagtggatctatcgaggctctacacggctggagcccatgttcagcatgaaaacatcctcagcctctgcactggagaagaagcaaggacagctcaggacacgtccaaatatgggtgctgtgaggagcaaaggccctgttgtccagtacacacaggatctgaccggtactggaacccagttcaagccagtggaacccccacagcctacagctccacctgccccacctttcccacctgctccacctctatccccccaagcaggtgacagtgaaagcttggaaagccagcttgcccagtcacggaagcaggtagccaaaaagagcacgtcctttcgaccaggatctgtgggctctggtcattcctcccctacatctcctgcactcagtgaaaatgtctctggtgggaaacctgggatcaaccagacatatagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttc

SEQ ID NO: 180851 - DNA, 2138 bp, Homo sapiens
  Payload ID: 15615
  Gene Symbol: SETDB2
  Gene Name: SET domain, bifurcated 2
  ENST ID: ENST00000258672
  CDS Start-End: 441-2087
gctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaaggatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaagtaggctttgtttcttctgtgaatgcctacctcttctgcctgtttctctgtctcttgctcaatacctgtagctcattttcttagattccataataaacatgctgcatttgtcagaaaggtta

SEQ ID NO: 180852 - DNA, 5619 bp, Homo sapiens
  Payload ID: 15615
  Gene Symbol: SETDB2
  Gene Name: SET domain, bifurcated 2
  Uniprot ID: Q96T68
  ENST ID: ENST00000317257
  CDS Start-End: 343-2466
gaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaaggatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaactcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaatatctggatcgataaaacactgtcccatcaaccatttgagtggggagagggagaagctcttctgtaagtaagattctggcaagctctttgaaatgagtcttctttcccacagattttctctactctttctatacaaacagataggagaagagggaatagaaacctggaggaacttgaatatttttgttctagatagagatacagttactgaaaaggaaacctagaaagtagtcacacgttgcttatttaggccagaagtaattgtactgggcaaaaatttcacttaaaaaacacaagaagtccaggtatggtggctcagacctgtaatcccagcactttgagaggccgaggcaggtggattacttgagcctaggggttcaagaccagcttgggcaacatgtcaaaaccctgtctctacaaaaaatacaaaaattagcctggcatgatggcatgtgcccgtagtctcagctactcaggagtgaggtgggaggatcatttgagctcagaaggtcaaggctgcaatgagacataatttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcccatctcttcactgtttctggaattcctgttttccagatgttagacctccagaatttgatctctaattttcctatcttttctcttaactttcagctctgtcttcttgctaggaccttttcctaggagcatttctcaatttaatcttccagttcatctgttgcattttatttttctagtctcatattgtctcatatttttaatttctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactgg

SEQ ID NO: 180853 - DNA, 6139 bp, Homo sapiens
  Payload ID: 15615
  Gene Symbol: SETDB2
  Gene Name: SET domain, bifurcated 2
  Uniprot ID: Q96T68
  ENST ID: ENST00000354234
  CDS Start-End: 826-2985
cctgcgctcgggaggtttgggcggcttggcgtcggaggagagccccacccgcggaggaacccagccttgccaacggagctggcggagctcactcctcaggtcaggcgggcggcgtagaaaacgcagcggagccaggtgaaaccaaggcaccgccgtggctggcccccgacagttcctctagccgggaggttggaggagctgaaaacgccgcggagccctcggccgcccgagcaggggctggaccccagcccttgcagcctcccttctcctggcacccaagtgcagtcctggctgcagaaggggccgcgggcgcactgagtttccaacctccatttcagcctgtctgtctcagggtgcagccttaatgagaggtgattcctaagctgctgggaacctgaggttgtcaaaggggcggcaggaaatggacagcagtataaaacccagaagcagaacttgaaggttaaaccactagcccatttcacagaatgtttcatccatttgtggaccaaaagatggagttggtttttatttttaaaaagataatgttaatgatctgataccactacaaatatttacgtgagaagattcatggacttgtcttttggttggactgtcactcatttctgaaagtttcttcagccacaatttctatttgaaaattcaagtatcaaaggataccaggtttagaatggtataatgatgtattttgtctgaggactgcaaattttatagagaccacagttggattccagtgatattctgcaatcaaagtgatttgataaacctaattttgaagcattttatatttataagcgacatcaaaagatgggagaaaaaaatggcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaagggagcatcacagaaagaagtgaatgcccaaagcagtgatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaactcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaatatctggatcgataaaacactgtcccatcaaccatttgagtggggagagggagaagctcttctgtaagtaagattctggcaagctctttgaaatgagtcttctttcccacagattttctctactctttctatacaaacagataggagaagagggaatagaaacctggaggaacttgaatatttttgttctagatagagatacagttactgaaaaggaaacctagaaagtagtcacacgttgcttatttaggccagaagtaattgtactgggcaaaaatttcacttaaaaaacacaagaagtccaggtatggtggctcagacctgtaatcccagcactttgagaggccgaggcaggtggattacttgagcctaggggttcaagaccagcttgggcaacatgtcaaaaccctgtctctacaaaaaatacaaaaattagcctggcatgatggcatgtgcccgtagtctcagctactcaggagtgaggtgggaggatcatttgagctcagaaggtcaaggctgcaatgagacataatttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcccatctcttcactgtttctggaattcctgttttccagatgttagacctccagaatttgatctctaattttcctatcttttctcttaactttcagctctgtcttcttgctaggaccttttcctaggagcatttctcaatttaatcttccagttcatctgttgcattttatttttctagtctcatattgtctcatatttttaatttctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactgga

SEQ ID NO: 180854 - DNA, 5313 bp, Homo sapiens
  Payload ID: 15615
  Gene Symbol: SETDB2
  Gene Name: SET domain, bifurcated 2
  ENST ID: ENST00000611815
  CDS Start-End: 1-2160
atgggtaagaaaccaagcgatgcaaaaactttctggatggagctagaagatgatggaaaagtggacttcatttttgaacaagtacaaaatgtgctgcagtcactgaaacaaaagatcaaagatgggtctgccaccaataaagaatacatccaagcaatgattctagtgaatgaagcaactataattaacagttcaacatcaataaagggagcatcacagaaagaagtgaatgcccaaagcagtgatcctatgcctgtgactcagaaggaacaggaaaacaaatccaatgcatttccctctacatcatgtgaaaactcctttccagaagactgtacatttctaacaacagaaaataaggaaattctctctcttgaagataaagttgtagactttagagaaaaagactcatcttcgaatttatcttaccaaagtcatgactgctctggtgcttgtctgatgaaaatgccactgaacttgaagggagaaaaccctctgcagctgccaatcaaatgtcacttccaaagacgacatgcaaagacaaactctcattcttcagcactccacgtgagttataaaaccccttgtggaaggagtctacgaaacgtggaggaagtttttcgttacctgcttgagacagagtgtaactttttatttacagataacttttctttcaatacctatgttcagttggctcggaattacccaaagcaaaaagaagttgtttctgatgtggatattagcaatggagtggaatcagtgcccatttctttctgtaatgaaattgacagtagaaagctcccacagtttaagtacagaaagactgtgtggcctcgagcatataatctaaccaacttttccagcatgtttactgattcctgtgactgctctgagggctgcatagacataacaaaatgtgcatgtcttcaactgacagcaaggaatgccaaaacttcccccttgtcaagtgacaaaataaccactggatataaatataaaagactacagagacagattcctactggcatttatgaatgcagccttttgtgcaaatgtaatcgacaattgtgtcaaaaccgagttgtccaacatggtcctcaagtgaggttacaggtgttcaaaactgagcagaagggatggggtgtacgctgtctagatgacattgacagagggacatttgtttgcatttattcaggaagattactaagcagagctaacactgaaaaatcttatggtattgatgaaaacgggagagatgagaatactatgaaaaatatattttcaaaaaagaggaaattagaagttgcatgttcagattgtgaagttgaagttctcccattaggattggaaacacatcctagaactgctaaaactgagaaatgtccaccaaagttcagtaataatcccaaggagcttactgtggaaacgaaatatgataatatttcaagaattcaatatcattcagttattagagatcctgaatccaagacagccatttttcaacacaatgggaaaaaaatggaatttgtttcctcggagtctgtcactccagaagataatgatggatttaaaccaccccgagagcatctgaactctaaaaccaagggagcacaaaaggactcaagttcaaaccatgttgatgagtttgaagataatctgctgattgaatcagatgtgatagatataactaaatatagagaagaaactccaccaaggagcagatgtaaccaggcgaccacattggataatcagaatattaaaaaggcaattgaggttcaaattcagaaaccccaagagggacgatctacagcatgtcaaagacagcaggtattttgtgatgaagagttgctaagtgaaaccaagaatacttcatctgattctctaacaaagttcaataaagggaatgtgtttttattggatgccacaaaagaaggaaatgtcggccgcttccttaatcatagttgttgcccaaatctcttggtacagaatgtttttgtagaaacacacaacaggaattttccattggtggcattcttcaccaacaggtatgtgaaagcaagaacagagctaacatgggattatggctatgaagctgggactgtgcctgagaaggaaatcttctgccaatgtggggttaataaatgtagaaaaaaaatattataaatatgtaactaacgcctgtttgtgaaattagcttatcaggctgaaattaaagccatgcaaaagaaggtctaggtccatcaaggaaattcccctccgttttcctttgtcatggggtttatgttttatttcagattttatttgtgtgacttagaaattccaggaacacaattaggatattttcatacacatagggtatcttgttcactgctgtgctactttacatgagtaggatggaagtgtatattttatatgaaataccactgtacaatttataatttatttacaaattatatattaagagaaacaaatgtcataacagaactcagctgtttctaattgcttttgtgactgttaccttttagttcatgcccccccaaagagctaaatttcacatttttacctacaaaattgatttttaattcctggcaaataatttaccattatgagctacaaggtgggcaacagcgcctgaggatctaattttatgcatattactcccaagtattttaacacttgttggagaagcaatatctggatcgataaaacactgtcccatcaaccatttgagtggggagagggagaagctcttctgtaagtaagattctggcaagctctttgaaatgagtcttctttcccacagattttctctactctttctatacaaacagataggagaagagggaatagaaacctggaggaacttgaatatttttgttctagatagagatacagttactgaaaaggaaacctagaaagtagtcacacgttgcttatttaggccagaagtaattgtactgggcaaaaatttcacttaaaaaacacaagaagtccaggtatggtggctcagacctgtaatcccagcactttgagaggccgaggcaggtggattacttgagcctaggggttcaagaccagcttgggcaacatgtcaaaaccctgtctctacaaaaaatacaaaaattagcctggcatgatggcatgtgcccgtagtctcagctactcaggagtgaggtgggaggatcatttgagctcagaaggtcaaggctgcaatgagacataatttcaccatagtacttccagcctgggcaatagagcaagactctctctcaaaaaaaacagcacacacacacacacacgaaaacaattctgaactatgaaatctgaaacagccccttggtatctcctgggcatgatttgcaaatcttttttttttacagaaaaaaggcaaagagtaagcactttgccataggttacttggccgtgatcatctatctagtggaaaaggggactgggaagcccaagcagactgggaaaccagacagctaggaaaaggagcaaaacatagcccagcaacctacagatgaagaaagttgagaaatccatttattcaccatagagacgcaggaatttcaggcaatgcactaaaatgaaatgggggaaaaaagcttgatcagtatgggaaccatttttgtgcaaaagggaatattatggatcagccagtatttctttgagctctgcctgtggagtccatttgacctttagaaatatgaggtattctgtcagttttatcttcttggagaaatttctcctaaaatcttgatttgctttagtctggactggttcatagccatcatcttccatcagtaccccagagattcactttgtctcttatgtgggatctgtttccagttagatgccattattttccttttccttggtttactcttccacatattggtaaagctcttccaatagcttttggaaaggaaaaatgaaaagtaaatgttttgaatctctgtgtgtttgacaatgtctttattttacccttatacctgattgctgttttggttggcaaggtataggattctttagtggtctccatgcccagttttgaagacatctgctagctttcagtgctgttgctgtggagtctgaaaatctgtcttctggcttccagggtgactactggaaattgaatgccattctgttccttctcttttgcatatataatccatttttatctctcttgaagcttataggtttatctttgtctcaatgttctgtccctgttaagagtccattttcatcctttgtactaggtgcctggtgggatcattccgtctgaaactaatgatttcccatctcttcactgtttctggaattcctgttttccagatgttagacctccagaatttgatctctaattttcctatcttttctcttaactttcagctctgtcttcttgctaggaccttttcctaggagcatttctcaatttaatcttccagttcatctgttgcattttatttttctagtctcatattgtctcatatttttaatttctaagagctccccttctccgaatattctttttttttaatagcatcctattttggctcatggttgcagtattttatctccttgaagatgtttgtgtgtttatgtatgtatatgcacacacgtatacatacacatacaggcatgcatctctgtattctttcggcataatctgtgtcctccagggtttgtttctttgtttcccctgtatgtttgttttggtcgttcacattataggctttcctcagagttaatggtcttggtagtctactcatatttaagtgtggaacaccaaaaagcttactataagctgagagtgtggtaaagggctctttgttttactatgacctacctgagctatcttgctggggaacaccctaatgtcagtctctttataaagggcctttcattttggcctggcaagaaatactctttcatcctcctgcatggagggcaaaaaaaaatttaaaaattggctgctagggtctgtctgctcacttccctgttttgcagaccccacactcttctgcaattcatttcatagttgtcaagactatacaaattgtcctttttaatgttctctcttctgctatccctagttggcagtcttcctctttacaacctgctgaaagtggaagacctccagttttcctttaattcctcagcaaaccaccaactattatatgtcttttttccagaacaacttattttttaactataattatatgcatttatgttagattcactgaaaacctcatcttgtatggtgctctgtaccctatgggtgctaaataaaggcttgctactggcaactgg

SEQ ID NO: 180855 - DNA, 2915 bp, Homo sapiens
  Payload ID: 15616
  Gene Symbol: SET
  Gene Name: SET nuclear proto-oncogene
  Uniprot ID: Q01105
  ENST ID: ENST00000322030
  CDS Start-End: 358-1191
cgccgtaggaggaggtggaggaggaggcggctcgggagagcgagcagcgagctggctggatcgccgagcgcgagtgagggagccgagccgcccgccgccgccgcctccgcctcccctccgcgaacaggagcccgggccggggcccggcacgccgccccagcccgtccctcggcgtcaggccgcgagggtagcgcgcgcgagcgagcgagggggagggagagcgagcgagcgccgggaggaggcggccggaccgagcgggcgcccgcgcgtgtggcgtgaggggaagccgcttgcccgcccccttcgccttcccttctctccccctccccgctccccccccgaccgcggagcagcaccatgtcggcgccggcggccaaagtcagtaaaaaggagctcaactccaaccacgacggggccgacgagacctcagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattt

SEQ ID NO: 180856 - DNA, 1029 bp, Homo sapiens
  Payload ID: 15616
  Gene Symbol: SET
  Gene Name: SET nuclear proto-oncogene
  Uniprot ID: Q01105
  ENST ID: ENST00000372686
  CDS Start-End: 2-799
gatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcattt

SEQ ID NO: 180857 - DNA, 801 bp, Homo sapiens
  Payload ID: 15616
  Gene Symbol: SET
  Gene Name: SET nuclear proto-oncogene
  ENST ID: ENST00000372688
  CDS Start-End: 1-801
atgatgcctcgctcccatcagccgccgccgccgccacatgaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaa

SEQ ID NO: 180858 - DNA, 2850 bp, Homo sapiens
  Payload ID: 15616
  Gene Symbol: SET
  Gene Name: SET nuclear proto-oncogene
  Uniprot ID: Q01105
  ENST ID: ENST00000372692
  CDS Start-End: 242-1114
gtgcccctgcagagcgaggcagagagcaactaaaagaaatttctcctgattggagggtgggtgggatgaggctgggggagggggccggggtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggcttgccgaagaagggagaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtcttttttttttttttttttttttttccctcttgtgctcagtcgccctgttcttgaggtctcttttctctactccatggttctcaatttatttggggggaaataccttgagcagaatacaatgggaaaagagtctctacccctttctgttcgaagttcatttttatcccttcctgtctgaacaaaaactgtatggaatcaacaccaccgagctctgtgggaaaaaagaaaaacctgctcccttcgctctgctggaagctggagggtgctaggcccctgtgtagtagtgcatagaattctagcttttttcctcctttctctgtatattgggctcagagagtacactgtgtctctatgtgaatatggacagttagcatttaccaacatgtatctgtctactttctcttgtttaaaaaaagaaaaaaaaacttaaaaaaatggggttatagaaggtcagcaaagggtgggtttgagatgtttgggtgggttaagtgggcattttgacaacatggcttctcctttggcatgtttaattgtgatatttgacagacatccttgcagtttaagatgacacttttaaaataaattctctcctaatgatgacttgagccctgccactcaatgggagaatcagcagaacctgtaggatcttatttggaattgacattctctattgtaattttgttcctgtttatttttaaattttctttttgtttcactggaaaggaaagatgatgctcagttttaaacgttaaaagtgtacaagttgctttgttacaataaaactaaatgtgtacacaaaggatttgatgcttttctctcagcataggtatgcttactatgaccttccaagtttgacttgtataacatcactgtcaaactttgtcaccctaacttcgtattttttgatacgcactttgcaggatgacctcagggctatgtggattgagtaatgggatttgaatcaatgtattaatatctccatagctgggaaacgtgggttcaatttgccattggtttctgaaagtattcacatcatttgggataccagatagctcaatactctctgagtacattgtgcccttgatttttatctccaagtggcagtttttaaaattggccttttacctggatataaattaattgtgcctgccaccaccatccaacagacctggtgctctaatgccaagttatacacgggacagttgctggcatgtcttcattggctatataaaatgtggccaagaagataggctctcagtaagaagtctgatggtgagcagtaactgtccctgctttctggtataaagctctcaaatgtgaccatgtgaatctgggtgggataatggactcagctctgtctgctcaatgccattgtgcagagaagcaccctaatgcataagctttttaatgctgtaaaatatagtcgctgaaattaaatgccactttttcagaggtgaattaatggacagtctggtgaacttcaaaagctttttgatgtataaaacttgataaatggaactattccatcaataggcaaaagtgtaacaacctatctagatggatagtatgtaatttctgcacaggtctctgtttagtaaatacatcactgtataccgatcaggaatcttgctccaataaaggaacataaagattttttttggactgg

SEQ ID NO: 180859 - DNA, 962 bp, Homo sapiens
  Payload ID: 15616
  Gene Symbol: SET
  Gene Name: SET nuclear proto-oncogene
  Uniprot ID: Q01105
  ENST ID: ENST00000409104
  CDS Start-End: 86-892
aagaagcactgaggaggagtcctacctcagggctcagtgtggacctgttggcacttttactgggtctcagtcccttttcctccacatgggatgcagagacctcctgcccagcttgaaacctaccttgctggaaaaagaacagcaagaagcgattgaacacattgatgaagtacaaaatgaaatagacagacttaatgaacaagccagtgaggagattttgaaagtagaacagaaatataacaaactccgccaaccattttttcagaagaggtcagaattgatcgccaaaatcccaaatttttgggtaacaacatttgtcaaccatccacaagtgtctgcactgcttggggaggaagatgaagaggcactgcattatttgaccagagttgaagtgacagaatttgaagatattaaatcaggttacagaatagatttttattttgatgaaaatccttactttgaaaataaagttctctccaaagaatttcatctgaatgagagtggtgatccatcttcgaagtccaccgaaatcaaatggaaatctggaaaggatttgacgaaacgttcgagtcaaacgcagaataaagccagcaggaagaggcagcatgaggaaccagagagcttctttacctggtttactgaccattctgatgcaggtgctgatgagttaggagaggtcatcaaagatgatatttggccaaacccattacagtactacttggttcccgatatggatgatgaagaaggagaaggagaagaagatgatgatgatgatgaagaggaggaaggattagaagatattgacgaagaaggggatgaggatgaaggtgaagaagatgaagatgatgatgaaggggaggaaggagaggaggatgaaggagaagatgactaaatagaacactgatggattccaaccttcctttttttaaattttctccagtccctgggagcaagttgcagtc

SEQ ID NO: 180860 - DNA, 235 bp, Homo sapiens
  Payload ID: 15616
  Gene Symbol: SET
  Gene Name: SET nuclear proto-oncogene
  ENST ID: ENST00000454747
  CDS Start-End: 140-235
actgaggaatgttccaagcttaggcagggcggctccagtgcagatttaagccgctggcacctggggcagtctcagtgttcagcctgcttccggacgggcgaggagactcgtggtctggttctgggacttccctaacagcatggcccctaaacgccagtctccactcccgcctcaaaagaagaaaccaagaccacctcctgctctgggaccggaggagacatcggcctctgcaggc

SEQ ID NO: 180861 - DNA, 909 bp, Homo sapiens
  Payload ID: 15617
  Gene Symbol: SETSIP
  Gene Name: SET-like protein
  Uniprot ID: P0DME0
  ENST ID: ENST00000596516
  CDS Start-End: 1-909
atggtctggttcttggacttccctaacagcatggcccctaaacgccagtctccactcccacttcaaaagaagaaaccaagaccacctcctgctctgggactggaggagacatcggcctctgcaggcttgccgaagaagggagaaaaagaacagcaagaagcaattgaacacattgatgaagtacaaaatgaaatagacagacttaatgaacaagacagtgaggagattttgaaagtagaacagaaatataacaaactccgccaaccattttttcagaagaggtcagaattgatcgccaaaatcccaaattttggggtaacaacatttgtcaaccatccacaagtgtcttcactgcttggggaggaggacgaagaggcactgcattatttgactaaagttgaagtgacagaatttgaagatattaaatcaggttacagaatagatttttattttgatgaaaatccttactttgaaaataaagttttctccaaagaatttcatctgaatgagagtggtgatccatcttcaaagtccaccaaaatcaaatggaaatctggaaaggatgtgacgaaacgttcaagtcaaacgcagaataaagccagcaggaagaggcagcatgaggaaccagagagcttctttacctggtttactgatcattctgatgcaggtgctgatgagttagaagaggtcatcaaagatgatatttggccaaacccattacagtattacttggttcctgatatggatgatgaagaaggaggagaagatgatgatgatgatgatgatgatggtgatgaaggggaggaagaattagaagatattgatgaaggggatgaggatgaaggtgaagaagatgaagatgatgatgaaggggaggaaggagaggaggatgaaggagaagatgactaa

SEQ ID NO: 180862 - DNA, 879 bp, Homo sapiens
  Payload ID: 15617
  Gene Symbol: SETSIP
  Gene Name: SET-like protein
  ENST ID: ENST00000485873
  CDS Start-End: 1-879
atggcccctaaacgccagtctccactcccacttcaaaagaagaaaccaagaccacctcctgctctgggactggaggagacatcggcctctgcaggcttgccgaagaagggagaaaaagaacagcaagaagcaattgaacacattgatgaagtacaaaatgaaatagacagacttaatgaacaagacagtgaggagattttgaaagtagaacagaaatataacaaactccgccaaccattttttcagaagaggtcagaattgatcgccaaaatcccaaattttggggtaacaacatttgtcaaccatccacaagtgtcttcactgcttggggaggaggacgaagaggcactgcattatttgactaaagttgaagtgacagaatttgaagatattaaatcaggttacagaatagatttttattttgatgaaaatccttactttgaaaataaagttttctccaaagaatttcatctgaatgagagtggtgatccatcttcaaagtccaccaaaatcaaatggaaatctggaaaggatgtgacgaaacgttcaagtcaaacgcagaataaagccagcaggaagaggcagcatgaggaaccagagagcttctttacctggtttactgatcattctgatgcaggtgctgatgagttagaagaggtcatcaaagatgatatttggccaaacccattacagtattacttggttcctgatatggatgatgaagaaggaggagaagatgatgatgatgatgatgatgatggtgatgaaggggaggaagaattagaagatattgatgaaggggatgaggatgaaggtgaagaagatgaagatgatgatgaaggggaggaaggagaggaggatgaaggagaagatgactaa

SEQ ID NO: 180863 - DNA, 3275 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000326197
  CDS Start-End: 301-2283
aagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagcatctagtgctttttgcatggcccaaaggggctctgtgctgctccactacagaggaaacttcaagaaatgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 180864 - DNA, 3108 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000337495
  CDS Start-End: 170-2116
acatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 180865 - DNA, 2906 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000361191
  CDS Start-End: 179-1912
ttaatcttatactttctttccacatgactatttttctctccctctgcagtgatagactggagtgatgttagaaaacacaaatatggtcacctatcagagtctgcatcccaatatcaagaagctgctgacatcctggatctagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 180866 - DNA, 3115 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000361705
  CDS Start-End: 346-2121
ttaatcttatactttctttccacatgactatttttctctccctctgcagtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 180867 - DNA, 3231 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000372595
  CDS Start-End: 440-2239
caagcagggggcatatttcagcccttttggtgttacagcaactcttttagccacgccgttcagcagatcccgagttcttgtcctgcaaccaggaagaatgaggtacgcagacaagtggagggtgagcaagatgaagaggtgctgtattgagcaatggaacagctcagagaagactcacagtgccagggcgtcccagtgagtgttcagcccctagcaggaaggatagctcctctctgcagtgatagactggagtgatgttagaaaacacaaatatggtcacctatcagagtctgcatcccaatatcaagaagctgctgacatcctggatctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 180868 - DNA, 3323 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000372596
  CDS Start-End: 598-2331
gcggaaacatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 180869 - DNA, 3252 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000372597
  CDS Start-End: 485-2260
gcggaaacatggcggcgggaagagagtgagccgccccgcgcccccgccgcgccctcagatggagaaattagcatacaaagaaactgacttgtcagaagtcagagcaaggtattggtggatccagggataaatcccaaacttcttaacccctagaccggtttttagtccattgactatgcagcctaatgtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagata

SEQ ID NO: 180870 - DNA, 3186 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000397171
  CDS Start-End: 459-2192
ttaatcttatactttctttccacatgactatttttctctccctctgcagtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 180871 - DNA, 2977 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000397174
  CDS Start-End: 1-1983
atgctggtttgctacagtgttttagcttgtgagattctctgggaccttccctgctccatcatggggtcacctctaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 180872 - DNA, 3204 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000402904
  CDS Start-End: 411-2210
gtgatagactggagtgatgttagaaaacacaaatatggtcacctatcagagtctgcatcccaatatcaagaagctgctgacatcctggatctagggttgtaaagaagattacatgagctaatggatgtgaaaacatcttaaaaactctcaaatacttttcaactttggaggattattatgattttcattctgttcagcggctatactcagactttactctaaaagtcaaatcttctgacattctttgaagtgaagcattctatgaatgtgagctgaagaaatgaatgaaatgaaataatgcaggtcattttacctgggacaaatacctaaaagaaacatgttcagtcccagcgcctgtccattgcttcaagcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttggatttcggctgaatgcgtcttcttggcccatgttccttttgaagacgctaaatggagcagagatggctcccatcaggattttccacaaggagccaccatcgccttcccacaacttcttcaaaatgggaatgaagctagaagctgtggacaggaagaaccctcatttcatttgcccagccactattggggaggttcggggctcagaggtgcttgtcacttttgatgggtggcgaggggcctttgactactggtgccgcttcgactcccgagacatcttccctgtgggctggtgttccttgactggagacaacctgcagcctcctggcaccaaagttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcaggtgggggcattcttctaggaatgaggggcatcagcccaccccaggcacctcagtggggttccgggccacctcaggactccaagaggctgtgtggagccaccactcctagccacagctgccatgataagtccttccatgaaggactgaggagggagagtgggggtccagggctggtgctgctcttccctcagctctgccggggctctaaggtccctctatttatttctcaaccctggctggcctctcaccaggagtttaggctgaatgccttccacgtgatggaggaaaaggccaactctgtcctggtcttgctgtggcaccccatcgccccacagctcgtaccttctcaccagattcccctgaatccaaactcgtggtgcaaacctctaccttttttacaaaaagatcttattgttaatttattgtttctggcacttgggcaaaccctgtagttaatactcctcccacactagacactgggtttcaggaggagggagactgccctgctttggtcccagagaggccctctgcagataggcgtggcccctcttcagaggacactaccctagggcactttctctttgaggtggagagacccataaagccttgaccacatcactccatatggggaggagaaggatccctgtcaccttctcctctcttcacggggcccttttgcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatatagatacc

SEQ ID NO: 180873 - DNA, 1586 bp, Homo sapiens
  Payload ID: 15618
  Gene Symbol: SCMH1
  Gene Name: sex comb on midleg homolog 1 (Drosophila)
  Uniprot ID: Q96GD3
  ENST ID: ENST00000456518
  CDS Start-End: 142-1584
tttcaactttggaggattattatgattttcattctgttcagcggctatactcagactttactctaaaagtcaaatcttctgacattctttgaagtgaagcattctatgaatgtgagctgaagaaatgaatgaaatgaaataatgcagtcctacacacctccaagcaacgagttcaagatcagtatgaaattggaagcacaggaccccaggaacaccacatccacctgtattgccacagtagttggactgacaggtgcccgccttcgcctgcgccttgatgggagcgacaacaaaaatgacttctggcggctggttgactcagctgaaatccagcctattgggaactgtgaaaagaatgggggtatgctacagccacctcttgttgtgattccaaagaatccctatcctgcctccgatgtgaatactgagaagcccagcatccacagcagcaccaaaactgtcttggaacatcaaccagggcagagggggcgtaaaccaggaaagaagcggggccggacacccaagaccctaatttcccatcccatctctgccccatccaagacagctgaacctttgaaattcccaaagaagagaggtcccaaacctggcagcaagaggaaacctcggactttgctgaacccaccacctgcctcaccaacaaccagcactcctgaaccggataccagcactgtaccccaggatgctgccaccatccccagctcagccatgcaggccccaacagtttgtatctacttgaacaagaatggcagcacaggcccccacttagataagaagaaggtccagcaactccctgaccattttggaccagcccgtgcctctgtggtgttgcagcaggctgtccaggcctgtatcgactgtgcttatcaccagaaaaccgtcttcagcttcctcaagcaaggccatggtggtgaggttatctcagccgtgtttgaccgggaacagcataccctcaacctcccagcagtcaacagcatcacctacgtcctccgcttcctggagaaactctgccacaaccttcgtagtgacaatctgtttggcaaccagccctttacacagactcacttgtcactcactgccatagagtacagccacagccacgacaggtacctaccaggtgaaacctttgtcctggggaatagtctggcccgctccttggaaccacactcagactcaatggactctgcctcaaatcccaccaaccttgtcagcacctcccaaaggcaccggcccttgctttcatcctgtggcctcccaccaagcactgcctcagctgtgcgcaggctatgctccagggggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaac

SEQ ID NO: 180874 - DNA, 735 bp, Homo sapiens
  Payload ID: 15618
  Gene Symbol: SCMH1
  Gene Name: sex comb on midleg homolog 1 (Drosophila)
  ENST ID: ENST00000472037
  CDS Start-End: 1-426
gtcagcacctcccaaaggcaccggcccttgctttcatcctgtggcctcccaccaagcactgcctcagctgtgcgcaggctatgctccaggggagtgttaaaaggatcaaatgaaagaagggatatggaatcattttggaaactaaatcgttccccagggtcggaccgatacctggagagccgcgatgcctctcgactgagtggccgggacccctcctcatggacagtcgaggatgtgatgcagtttgtccgggaagctgatcctcagcttggaccccacgctgacctgtttcgcaaacacgagatcgatggcaaggccctgctgctgctgcgcagtgacatgatgatgaagtacatgggcctgaagctggggcctgcactcaagctctcctaccacattgaccggctgaagcagggcaagttctgaaccaggagaggcagcctagacaaccaagtggcagcagccctaggcctcatctgtgggaagggagtccctggcttatactgcccccaccacagctccttgccctggccagaactgctgtcgaagaaaatcaggccggaaggccaagaaggcgctaagggggatgggagggcaggttttccaggctggagtcggttccacccactcgcctgtccacaggcttccttgtaagcaagtcagcagcacagctactcacgctgccatctggacttattttatgtcaatctgtttataaataaaaaccaatataga

SEQ ID NO: 180875 - DNA, 1997 bp, Homo sapiens
  Payload ID: 15619
  Gene Symbol: SCML1
  Gene Name: sex comb on midleg-like 1 (Drosophila)
  Uniprot ID: Q9UN30
  ENST ID: ENST00000380041
  CDS Start-End: 329-1318
ggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgataaaaacaagaatacctacttacgatgaagatgacaacactattctttatgcgtatgaaacaaaacctgaatttgtcaataaagaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttg

SEQ ID NO: 180876 - DNA, 2830 bp, Homo sapiens
  Payload ID: 15619
  Gene Symbol: SCML1
  Gene Name: sex comb on midleg-like 1 (Drosophila)
  Uniprot ID: Q9UN30
  ENST ID: ENST00000380043
  CDS Start-End: 329-1237
ggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttca

SEQ ID NO: 180877 - DNA, 2679 bp, Homo sapiens
  Payload ID: 15619
  Gene Symbol: SCML1
  Gene Name: sex comb on midleg-like 1 (Drosophila)
  Uniprot ID: Q9UN30
  ENST ID: ENST00000380045
  CDS Start-End: 460-1086
cggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaataggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttca

SEQ ID NO: 180878 - DNA, 2704 bp, Homo sapiens
  Payload ID: 15619
  Gene Symbol: SCML1
  Gene Name: sex comb on midleg-like 1 (Drosophila)
  Uniprot ID: Q9UN30
  ENST ID: ENST00000398080
  CDS Start-End: 482-1108
aaccgcgagtgtgggaattcggcgtcgcgggagctctctgatccactcaggggtcagggcatcactggtctcgcgtgcgcgtgaccaggcccggtttccggtgccaggacctttccgaagcgtcgagtggcctaacggtcacagctgtcgcccatcggagaggcaggactactgcgagcagttttaccgcgacctccggaggccggcgtgacaggctctgtcactaaaatagcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcctcagccgcactccgagtccagtgcatccctcagatttctctgagcataattgtcagccgtattatgcatctgatggtgcaacgtatggttcttcttcagggctctgccttggcaaccctcgggctgacagcatccacaacacttactcaactgaccatgcttctgcagcaccaccttcagttacaaggtcaccagttgaaaatgacggttacatagaggaaggaagcatcactaagcacccttcaacctggtcggtggaagcagtggtcctatttctaaaacaaacagatcctcttgcattatgccctcttgtcgacctcttcagaagccatgaaattgacgggaaggctctgctcctactcacgagtgacgtgttgctgaagcacttgggggtgaagctgggaacggctgtgaagctatgctactacattgaccgacttaaacaaggaaaatgctttgaaaattgaaaaaatccttgtgcaaatttagattgggccaacttctagaggcaccaatgccttcttagtgtggaatcatttttctgccctttagtcgtttttgttttgtagaaagtatctctcaaaatatattatagctagaattgtagaactatgttatagtccagtctacttctttaaaaaccatttaaactgctagatagtattagaatagtccaatagaaaattcattctttataggtctttaaaaattacttttattatattgtttacaaatatatttcatgcaagaaacagaaaaaaaaaaaaaccctttgattctggttcatctcgatacagagaaccaaaacagctaagagaggtattatcagggttgacaactcctatgattgaatctatgggaattattcctcagaagagaatttaaaggtgtacccatatatatctctttctggagtattttatctgtctgatgttgcagtattctacaagtttccagaaagagaatagccatataaattattttcctttctgctattatttctctatatgttttatttattcagatttagagtaaaaaataagcatataaacttttattatgtgctcttaacagttttaagataaactataggatagatagaatggttattttatgcaagaaatattgtaccgcaagggtggtttggatgaagtctgactactttttttcaaacaaactattatattaaaactgtcatattttggctaagtttggacctataactacactttcattgtttgcatctctctatgaagatacgtctgtccaaacttttaaaaggcataactgtattttatgtgtttattctttatatagatagtattttatattttattctcacccgaagtattcacacaatctttttaaaaaaaatttgaaatggcattttgtattgccacagaggtaggatgagccatatattagtgaaatgttttattttgtaaaatataaatggattatttgccatcattagtacctctcaacttactttttagaggacaagaaacaatctgtagattggtttccatacagggaagttctccgtcctatgcaatgtttctaattaatttgcttaattctgagccattaatcctgctacactttgaatgatacattaattcagactaatctttgggggctttattttgtaagttagaactttcaagggaaacatgttcaacactattattttgttataaatttataactttgttattacattgtgtaacaaatataaggtttacgagctatgagaattggtgctatcaccattagctatttgctgtaatgtcaagaaaatgttcaccagatgcaagaatgtaccttttctttttagaaagccaaatgtactttagacatgaatgcaactatttaaagaatagcttcatcaatgttattccttacatgtcataagattcttacttaaacttggtcttctttcaaattgtttgtatgaagatgctgtacccacttgaacagtcctcaggtgtttacataaatactatgttttacagttttcatattttaaaatattaataaagttaaatcacaatagttcattg

SEQ ID NO: 180879 - DNA, 817 bp, Homo sapiens
  Payload ID: 15619
  Gene Symbol: SCML1
  Gene Name: sex comb on midleg-like 1 (Drosophila)
  ENST ID: ENST00000419185
  CDS Start-End: 375-817
gggaatacacgatttggcttaggggccggggctctcctgaggagagagggtttgctttgcggggaagagcgagtcttgacttcgcagcctccaatttcagccgcggtgtggaggggggtgctttgggtggtccccacagcctttccggagtgcccgcgcgtgtaagcttttgagatttgacaatttgtgaagtgcttggtgctgactttcggggacgacaggatccttttacagtcattctcctgtcaggggaggcaggagtagaggtttaccactcttaggtgactaagcagtatcacaaataaaccctccagcaagtttaaaaataattaggtccaactcagaggaagtggagtttctcctgttgcacaaaaatgatgtctaacagctccagtgaaatcgatgtgcaggaaccgaatattgtatctgacgcatcctgtaatactgaagagcaactgaagacagttgatgatgtccttattcattgccaggttatatatgatgctctgcaaaacctggataagaagattgatgtgattcgtagaaaggtttcaaaaatccaacgtttccatgcgagatccctgtggacaaatcataagcgatatggatataaaaagcattcttaccggcttgttaaaaagcttaaactccagaaaatgaagaaaaatgaggtttacgagacattctcctaccctgaaagttacagccccactttaccagtgtcaaggcgtgagaataattccccgagcaaccttccaaggccatccttttgcatggaagaataccagcgagctgagctggaggaggacccgatcct

SEQ ID NO: 180880 - DNA, 4200 bp, Homo sapiens
  Payload ID: 15620
  Gene Symbol: SCML2
  Gene Name: sex comb on midleg-like 2 (Drosophila)
  Uniprot ID: Q9UQR0
  ENST ID: ENST00000251900
  CDS Start-End: 161-2263
ggcggcagtggcggttgcggggcatgcgcggctccgcgcgcggcttctcaaacatggcggcggcggtgtgaagctcggtgccggctcgcgcgatcggtgggacagaatttcgttgttttcaccgacgagactggaggaaacaacaccaaatagggataccatgggacaaacagtgaatgaagattccatggatgtcaagaaggagaatcaagagaaaactcctcagtcaagtacatcttctgtacaaagggatgatttccactgggaggagtatttgaaagagactgggtctataagtgctccttcagagtgcttccgtcagtctcagattccacctgtgaatgatttcaaagttggtatgaaattggaagcccgtgaccctcgcaatgccacttcagtatgtattgctacggttattggaattactggggccaggttacggttacgactggatggtagtgacaacagaaatgatttttggaggcttgtcgattccccagacatacaacctgttgggacatgtgaaaaggaaggagacttacttcaacctccactagggtaccagatgaatacatcctcctggccgatgttcctcttaaagacactaaatgggtctgaaatggcatctgccacattatttaagaaggaaccaccaaagcccccactaaataattttaaagtggggatgaaactggaagctattgacaaaaagaacccgtatctcatctgtcctgcgaccattggagatgttaaaggggatgaagttcatatcacatttgatggctggagtggagcttttgattactggtgcaagtatgattctcgagatattttcccagctgggtggtgtcgcctgacaggagatgtattacaacccccaggaactagtgttcctattgtaaagaatatagcaaaaacagagtcttctccttccgaagcaagccagcattcaatgcagtctccacagaaaactactctaatattaccaacacagcaggtcaggagatcaagtcgaattaaaccacctggacctactgcagtccccaaaaggagcagttctgttaaaaatatcacaccaaggaaaaaaggtccaaactcaggaaaaaaggaaaaacctttgcccgtgatatgttctacatctgcagcttctctaaaatcgctgaccagagaccgtggcatgttatataaagatgtcgcttctgggccatgtaaaatagtgatgtctacagtctgtgtctatgtaaacaaacatggaaactttggccctcatctggatcccaagagaatccagcagctgcctgaccacttcggcccgggcccggtgaatgtggtgcttcgccggattgtgcaggcctgtgtggattgtgcccttgaaactaaaactgtttttggatacctgaagccagataatcgtggaggagaagtgataactgcctcctttgatggggaaactcattccatccagctccctccagtgaacagtgcatcatttgctcttcgctttcttgagaacttctgccacagtctgcagtgtgataaccttttgagtagccagccttttagttcttccaggggtcatactcacagctctgcagagcatgataaaaatcagtcagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattc

SEQ ID NO: 180881 - DNA, 1334 bp, Homo sapiens
  Payload ID: 15620
  Gene Symbol: SCML2
  Gene Name: sex comb on midleg-like 2 (Drosophila)
  Uniprot ID: Q9UQR0
  ENST ID: ENST00000398048
  CDS Start-End: 44-460
actaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaagctccaagttatatagctgtacctgatcccagtgtcctgaaacaaggcttctctaaggacccttcaacctggtctgtggatgaagtgatacagtttatgaaacatacagatcctcagatatcaggccccctcgccgacctcttcaggcaacatgaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacg

SEQ ID NO: 180882 - DNA, 2435 bp, Homo sapiens
  Payload ID: 15620
  Gene Symbol: SCML2
  Gene Name: sex comb on midleg-like 2 (Drosophila)
  ENST ID: ENST00000420857
  CDS Start-End: 1-377
cagcaaaagaagatgtaacagaaaggcaaagcaccaaacgatctcctcagcaaactgtaccatatgttgttcctctctctcctaagctccccaaaacaaaggagtatgcgtctgaaggagaaccattgtttgctgggggaagtgccattcccaaagaggagaatctttcagaagattctaagagctcatcactaaattcaggaaattatttgaatcctgcctgtagaaatcctatgtatattcatacttcagtctcccaggatttttctcgaagtgtgccaggcaccacaagttcaccactagttggggacatatcccccaagagcagtccccatgaagttaaattccaaatgcagaggaaaagtgaaggaaattgatgggaaggctctgttcctactcaagagtgatgtgatgatgaagtatatggggctgaagctggggccagcattaaagctgtgttactacattgaaaagcttaaagaaggaaaatacagttaaaaaaatgtgtaagtttagattggacataattctcaggtgtactgttaacattttaatttaaaagtatttctcttagcagtttttgttttgtagacagttcccataaaaatattttatcagaattgcagaactgtagtaacagttcagtcaactttgtttttttcctggagtcaccaaccagctttgggagacacagccgccactcccccagtctacttctttaaaaagcatttaacaggttagtattggcatattcaaattggcagttctttatgtctttttaaattttcattgtacagtttacaaatatacttaatgtagttaacagagaaaaacctttgattttggttaacctttatatctagaaccaaaacagctaaatcccaaaggggaaaatatcagggattgacaacttctataattaaatccatgagaatttttcctcactagagaatttaaaggtgcacctgtagatatcatcttttctcagatattttgtgtgatactctgtggtgttctgttcatgttctatcagtatatctagaaagggaatagccatataaattattttccttttattatttctctgtatgttgtatttgatcatatttaaaggaaaaaagcaagcttataagctttcatgaagtgttcttaccagtttttgataaattttttaaattataggatagaattgtcattttatgcaggagatatttatactacgagggttgtttggatggagtcagattaaattttttcagtgaaattcctattattttaaaactttccatattttcactacgcttggacatttaactaggcattcttttcttacatctctatatgaagatacctgtgtccaaaatttttgaagatatatattgtatgtgtttattcttcatatggtactttaccatatttatatattgttttatacctgtaggtttacacacaagtaaatcttttttttcttgaatttaatctggcactttgcactgccacagaggtgacgatgaactatgtatatagttagatgttttgatttcgtaaaaaatatatgtccatcgtttgctatcaccagtacctctcagcttactcttcaggggatatgaaacaatctgtagattggtttccatacagggaagttctctgtcctatgcaatgtttctaattaatttgcttagttctgagccatttattctgctacactttgaaagatatattagttctgacttattgtttggggctttattttatttttatttttttgagatggagtttcactcttgttgcccaggctggagtgcaatagctcgatctcggctcactgcaacctcgcctccctggttcaagcaattctcctgcctcagcgattacaggaatgcaccaccacgcccagctaattttgtagagatggggtttctccatgttggtcaggctggtctcaaactcctgacctcaggtgatccgcccacctcggccttgcaaaatgctgggattacaggcatgagccaccatgcccagccatgtttggggctttattttataagttagaactttgaagaggaaatggtgctatatgtttattgttattactttgtgtaactttgatgtaatgtttataagctatgagaatcagttataaaagtattagccatttgttgtaaatgccaataaaatattcaccaggggcaagaatgtacattttctttttagaaaaccaaatgtactttagacatgaatgcaactatttaaagaatagcttcatttatgttattccttacatgtcataagattcttacttaaacttggtcttctttcaagttgtttgtatgaagatgctgtacccacttgaacagtcctcaggtgtttacataaatactatgttttacagttttcatattttaaaatattaataaagttaatcgcaacgattc

SEQ ID NO: 180883 - DNA, 1491 bp, Homo sapiens
  Payload ID: 15621
  Gene Symbol: SCML4
  Gene Name: sex comb on midleg-like 4 (Drosophila)
  Uniprot ID: Q8N228
  ENST ID: ENST00000369020
  CDS Start-End: 247-1491
cattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagcacctcttctgcctgtgagcgatttgtcacctcattctgtaagactggcaccagcagaaatgcagtctcaaaggatcccggggagaaagcgaggccgaccctcacttcactccacgcctatgaagatggcagttcataacctttattctgcttcagctggctctttaccagcagtgaagatcccaaagaaaagagggcggaaacccgggtacaagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctga

SEQ ID NO: 180884 - DNA, 2056 bp, Homo sapiens
  Payload ID: 15621
  Gene Symbol: SCML4
  Gene Name: sex comb on midleg-like 4 (Drosophila)
  Uniprot ID: Q8N228
  ENST ID: ENST00000369021
  CDS Start-End: 106-1023
ataacctttattctgcttcagctggctctttaccagcagtgaagatcccaaagaaaagagggcggaaacccgggtacaagaaacctaaggcaacaacaaagacaaatgccctgccagagaacagcttggataggttgcgacaggcagagaacccccccattccactggagagagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtggtaatgtaatgcatgcatcagcttcccactgacttaacatcccttgcccttgcgcggggagcacagcatctggggaagggggagtgtggctgtttaaacgtgggactgctgggagatcagaaatttccacaagtcctttcatggatcttgaggttctcaaaaacagccaaactcaacctttgataagcaaagaaaatcgtgtattagggcaggctaggccacaggatacgtagactccaaaatgtacacaggctcaaataccatagaaatttttgttcgagagccaaaggtgaatgttcctgattcatggatgcatctcaatatagggacataggctccatctattttgtggctctgccaccctctacagccttcatgccccatgcattagggaatagaaagggaaagaaggtgtggagaagacacaggtgcttccctgcaatctgaaagtgatgctcatcacttccactcacatctcattggcaaaagctggtcattttgccacacttaaccataagggactctggaagctgtaggttagctctgcccaggagaaaggagaaccagaccttggtaaagaattgtctcttgcataggaagtgtcaccttcaggatacaaatacatgagcagaggcagagttaggcaaaattcccccaatgctggttgtaatgccacttctgtctcatccactaaagaaagcttgttggaatgcagtctacaaaagcgctataagggctaaaggattatagtaatagcttgaaggcccttctgattgatgttttaaaaaatcattttcaagcttcagtattttgatagtgcctaaaggccatagagtatagtggataatcactgggactagagccagacagcctgggctgagatgctggatctgctgcttcctgcctaccttttgcaagtcttaacttacctgtgcttcagtttcctcacctataaaattgtgataataataatgggcagccttgatttcataggtttgtccccagtgttagcttaatatctggcatgtggtaggtgttcaataaacatgcatcatgtctgtgccc

SEQ ID NO: 180885 - DNA, 2377 bp, Homo sapiens
  Payload ID: 15621
  Gene Symbol: SCML4
  Gene Name: sex comb on midleg-like 4 (Drosophila)
  Uniprot ID: Q8N228
  ENST ID: ENST00000369022
  CDS Start-End: 211-1281
gaatgcattagtctaatgagatgtttgcagctggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctgacttttttaaaaagacagaagcgaaacccaaaacaacagatcccaagattatcttctgccttaccaatatcccgccaacatcacaaactagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtgatttttaacatccctgttatgctggtttctcttaaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaaaaaatcttttctgttcctagaaaatctgaagtactgtgtttctccgctagagggcagactgctaatgaaatttcaggaccctcactgactgcagtagcaggattgttcagtactgagtggatgggttagggtgtctgtgaacaagatctagcccacacagaaacaggggatttattccacagttagcaccacagattgcgacttgggaagaaaccatcagctagaggggtctagttcgtatccaatcattattgactgactgactgatactcaactagcaaaggcaagaatttggaagcacgctctacccagatgggactttggagttccttcccttccagagtccttattgaggtgttgaagtgttggcatgccgaagaatcttagtgacatttagccatgggtgtttctttaaaaaaggaaaagaaaatgtctcaacgaagctttgaaatgggagagtgttgatttctagttacattgctgggttatgtagttgtatctgtggctaatttttctagtcctcaacaaatacacagacatgctatta

SEQ ID NO: 180886 - DNA, 1534 bp, Homo sapiens
  Payload ID: 15621
  Gene Symbol: SCML4
  Gene Name: sex comb on midleg-like 4 (Drosophila)
  ENST ID: ENST00000369025
  CDS Start-End: 467-985
atctgaactgcagagacaaccttagagagaaaatccatactggccagagaccaagttaatggaaaatttaattgaagcaaatgaaatgctcagcctcataggtagtatggccctgtgccctttgaaccagaaaggctgggccaggaggccacagagggccctaagggaaaactcccttatctgcaagaacaaggggcgggactgagtttgagaaaagaaaatctgcaaacctccacaggagcctcagtgaaaggctgcatgcaggggaggaaaccttcaggttttggtcaccaggaagtccgttagagattcacagcagaaggcccctctgcatcccacagcaccaagcacgtgctggaaaccggcggtcccccagaggacagtgggagaggctgccgggtggcagagacacaaccaccaagtcaagacagtcaccaccgaagagtacctggtgaaccctgtgggcatgaaccgctacagcgtggacacctccgcctccacctttaaccacaggggctccttgcacccctcctcctcgctgtactgcaagaggcagaactctggagacagccaccttgggggtggtcctgctgccaccgctggtggtccccgcactagccccatgtcttctggtggcccctcggcacctgggctgaggcctccagcctccagccccaagagaaacacgacctctcttgaaggaaacagatgtgcctcaagcccttctcaggatgcgcaggatgccaggcggccacggagcaggaacccctccgcctggactgtggaggacgtggtgtggtttgtgaaggacgccgacccacaggctctggggcctcacgtggagctcttcagaaagcacgagattgatggcaacgctctgctgttgctgaagagtgacatggtcatgaagtacctgggcctgaagctgggacctgcactgaaactctgctaccacattgacaaactgaagcaagccaagttctgacttttttaaaaagacagaagcgaaacccaaaacaacagatcccaagattatcttctgccttaccaatatcccgccaacatcacaaactagactctcctcttaaaattaacagccacagagacgtggtctttttataaaacttgtgaatctttgccttttgaagaatttaacatggaccttttcgagaggctcctctgtgttcataatttgccaaaaaattacaaaagcctgtgatttttaacatccctgttatgctggtttctcttaaagtgggtcctatttgcataacgagagagtggggaactgaatgcttatgcccaaggagagttctggagggttcaaaggatgaaagaaggacctttgtccctgcggtctctgcagggacaaccccctcagcaccatctgcctctaactctgacctggggacctatccatgtgagccttgtttgcctcagctctggaagctgacttctgaagatgactgcctcaccttgcactgtctggaaaacttgaattattttacgccgtgaaagaaaaaggaaaaaaaaa

SEQ ID NO: 180887 - DNA, 779 bp, Homo sapiens
  Payload ID: 15621
  Gene Symbol: SCML4
  Gene Name: sex comb on midleg-like 4 (Drosophila)
  ENST ID: ENST00000426221
  CDS Start-End: 180-695
tggagcgcagggctgctggagactaactgtgagctactaacacgggtggaagatagcttttgcaatactcggtttgcatgtgctgaaagtcatctgtcttctgagtcaacactcccgacctggtaaacaacctgctcagggctctggtgaacaagctgtagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcaggaggatgacagccttccttcctaaaagctgatgtccccatctgaaagctggttttcctcccagtcagctgggaggtttggaagtaatgaccc

SEQ ID NO: 180888 - DNA, 700 bp, Homo sapiens
  Payload ID: 15621
  Gene Symbol: SCML4
  Gene Name: sex comb on midleg-like 4 (Drosophila)
  ENST ID: ENST00000440927
  CDS Start-End: 106-700
ataacctttattctgcttcagctggctctttaccagcagtgaagatcccaaagaaaagagggcggaaacccgggtacaagaaacctaaggcaacaacaaagacaaatgccctgccagagaacagcttggataggttgcgacaggcagagaacccccccattccactggagagagatcaagtctcgggttctcatgactcccttagccctctcacctccgcggagtaccccagagcccgacctcagctccatccctcaggacgcagccacggtccccagcttggcggccccacaggctctcacagtctgcctctacatcaacaagcaggccaatgcggggccctatctggagaggaagaaggtgcagcagctcccggagcattttgggcccgagcggccatcggcggtgctgcagcaggccgtccaagcctgcatcgactgcgcccaccagcagaagctggtcttctccctggtcaagcagggctatggtggtgagatggtgtcagtctcggcttcctttgatggcaaacagcacctgcggagcctgcctgtggtgaacagcatcggctatgtcctccgcttcctcgccaagctgtgccgaagcctcctgtgcgatgacctcttcagccaccagcccttccccaggggctgcagtgcctctgagaaagtccaggagaaagaggaagggaggatggaatcag

SEQ ID NO: 180889 - DNA, 845 bp, Homo sapiens
  Payload ID: 15622
  Gene Symbol: SRY
  Gene Name: sex determining region Y
  Uniprot ID: Q05066
  ENST ID: ENST00000383070
  CDS Start-End: 97-711
gtaacaaagaatctggtagaagtgagttttggatagtaaaataagtttcgaactctggcacctttcaattttgtcgcactctccttgtttttgacaatgcaatcatatgcttctgctatgttaagcgtattcaacagcgatgattacagtccagctgtgcaagagaatattcccgctctccggagaagctcttccttcctttgcactgaaagctgtaactctaagtatcagtgtgaaacgggagaaaacagtaaaggcaacgtccaggatagagtgaagcgacccatgaacgcattcatcgtgtggtctcgcgatcagaggcgcaagatggctctagagaatcccagaatgcgaaactcagagatcagcaagcagctgggataccagtggaaaatgcttactgaagccgaaaaatggccattcttccaggaggcacagaaattacaggccatgcacagagagaaatacccgaattataagtatcgacctcgtcggaaggcgaagatgctgccgaagaattgcagtttgcttcccgcagatcccgcttcggtactctgcagcgaagtgcaactggacaacaggttgtacagggatgactgtacgaaagccacacactcaagaatggagcaccagctaggccacttaccgcccatcaacgcagccagctcaccgcagcaacgggaccgctacagccactggacaaagctgtaggacaatcgggtaacattggctacaaagacctacctagatgctcctttttacgataacttacagccctcactttcttatgtttagtttcaatattgttttcttttctctggctaataaaggccttattcatttca

SEQ ID NO: 180890 - DNA, 1311 bp, Homo sapiens
  Payload ID: 15623
  Gene Symbol: SHBG
  Gene Name: sex hormone-binding globulin
  ENST ID: ENST00000340624
  CDS Start-End: 247-1281
gtgactgggctcctgggtagagttcaaggttggagtgaagcggcttccttgcggttgtgtgggtgtcccaacctgggtcgagataccccgcggttcaaaggctcccccgcagtgctttttaaattgacatatgcagtgataacctgctttagcctcaggctcactcacccgcccagaccctggagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 180891 - DNA, 1271 bp, Homo sapiens
  Payload ID: 15623
  Gene Symbol: SHBG
  Gene Name: sex hormone-binding globulin
  Uniprot ID: P04278
  ENST ID: ENST00000380450
  CDS Start-End: 32-1240
gtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtta

SEQ ID NO: 180892 - DNA, 1042 bp, Homo sapiens
  Payload ID: 15623
  Gene Symbol: SHBG
  Gene Name: sex hormone-binding globulin
  Uniprot ID: P04278
  ENST ID: ENST00000416273
  CDS Start-End: 22-903
ccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccc

SEQ ID NO: 180893 - DNA, 973 bp, Homo sapiens
  Payload ID: 15623
  Gene Symbol: SHBG
  Gene Name: sex hormone-binding globulin
  Uniprot ID: P04278
  ENST ID: ENST00000441599
  CDS Start-End: 80-943
accgcccacacgcaaggctgcctgcctctacacattctcccaagagttgtctgagccgccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccctttgaaagtt

SEQ ID NO: 180894 - DNA, 938 bp, Homo sapiens
  Payload ID: 15623
  Gene Symbol: SHBG
  Gene Name: sex hormone-binding globulin
  ENST ID: ENST00000574539
  CDS Start-End: 110-817
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180895 - DNA, 1158 bp, Homo sapiens
  Payload ID: 15623
  Gene Symbol: SHBG
  Gene Name: sex hormone-binding globulin
  ENST ID: ENST00000570353
  CDS Start-End: 22-567
ccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccc

SEQ ID NO: 180896 - DNA, 1146 bp, Homo sapiens
  Payload ID: 15623
  Gene Symbol: SHBG
  Gene Name: sex hormone-binding globulin
  ENST ID: ENST00000575314
  CDS Start-End: 110-1144
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180897 - DNA, 526 bp, Homo sapiens
  Payload ID: 15623
  Gene Symbol: SHBG
  Gene Name: sex hormone-binding globulin
  ENST ID: ENST00000575729
  CDS Start-End: 247-526
gtgactgggctcctgggtagagttcaaggttggagtgaagcggcttccttgcggttgtgtgggtgtcccaacctgggtcgagataccccgcggttcaaaggctcccccgcagtgctttttaaattgacatatgcagtgataacctgctttagcctcaggctcactcacccgcccagaccctggagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgc

SEQ ID NO: 180898 - DNA, 479 bp, Homo sapiens
  Payload ID: 15623
  Gene Symbol: SHBG
  Gene Name: sex hormone-binding globulin
  ENST ID: ENST00000572182
  CDS Start-End: 110-358
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180899 - DNA, 760 bp, Homo sapiens
  Payload ID: 15623
  Gene Symbol: SHBG
  Gene Name: sex hormone-binding globulin
  ENST ID: ENST00000571153
  CDS Start-End: 1-639
tgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180900 - DNA, 801 bp, Homo sapiens
  Payload ID: 15623
  Gene Symbol: SHBG
  Gene Name: sex hormone-binding globulin
  ENST ID: ENST00000570547
  CDS Start-End: 110-799
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180901 - DNA, 1196 bp, Homo sapiens
  Payload ID: 15623
  Gene Symbol: SHBG
  Gene Name: sex hormone-binding globulin
  Uniprot ID: P04278
  ENST ID: ENST00000575903
  CDS Start-End: 22-1176
ccgagtggacagtggctgattatggagagcagaggcccactggctacctcgcgcctgctgctgttgctgctgttgctactactgcgtcacacccgccagggatgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccc

SEQ ID NO: 180902 - DNA, 776 bp, Homo sapiens
  Payload ID: 15623
  Gene Symbol: SHBG
  Gene Name: sex hormone-binding globulin
  ENST ID: ENST00000576728
  CDS Start-End: 110-655
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaagagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180903 - DNA, 463 bp, Homo sapiens
  Payload ID: 15623
  Gene Symbol: SHBG
  Gene Name: sex hormone-binding globulin
  ENST ID: ENST00000575618
  CDS Start-End: 1-342
tgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180904 - DNA, 984 bp, Homo sapiens
  Payload ID: 15623
  Gene Symbol: SHBG
  Gene Name: sex hormone-binding globulin
  ENST ID: ENST00000572262
  CDS Start-End: 110-982
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180905 - DNA, 785 bp, Homo sapiens
  Payload ID: 15623
  Gene Symbol: SHBG
  Gene Name: sex hormone-binding globulin
  ENST ID: ENST00000576830
  CDS Start-End: 1-783
tgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180906 - DNA, 639 bp, Homo sapiens
  Payload ID: 15623
  Gene Symbol: SHBG
  Gene Name: sex hormone-binding globulin
  ENST ID: ENST00000576478
  CDS Start-End: 110-637
aattctccatgtgcttggatcgtggggaagatgtgattaaggtctaagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180907 - DNA, 1382 bp, Homo sapiens
  Payload ID: 15623
  Gene Symbol: SHBG
  Gene Name: sex hormone-binding globulin
  ENST ID: ENST00000570527
  CDS Start-End: 22-195
ccgagtggacagtggctgattatggagagcagaggcccactggctacctcgcgcctgctgctgttgctgctgttgctactactgcgtcacacccgccagggatgggccctgagacctgttctccccacccaggtgcaggagcgggacagggcactcagctcatgcagtcttcccttctctcctctggccctgtagcagggcctctccctctgtctgtctctgacatgtccctactcagctttgtttgttttctctttctgatagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccaggtggaagtcaagatggagggggactctgtgctgctggaggtggatggggaggaggtgctgcgcctgagacaggtctctgggcccctgaccagcaaacgccatcccatcatgaggattgcgcttggggggctgctcttccccgcttccaaccttcggttgccgctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgagacattccccagcctcatgcagagccctgggccttctctttggacctgggactcaagcaggcagcaggctcaggccacctccttgctcttgggacaccagagaacccatcttggctcagtctccacctccaagatcaaaaggtggtgttgtcttctgggtcggggccagggctggatctgcccctggtcttgggactccctcttcagctgaagctgagtatgtccagggtggtcttgagccaagggtcgaagatgaaggcccttgccctgcctcccttaggcctggctcccctccttaacctctgggccaagcctcaagggcgtctcttcctgggggctttaccaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaagctccacctaagaaccccc

SEQ ID NO: 180908 - DNA, 623 bp, Homo sapiens
  Payload ID: 15623
  Gene Symbol: SHBG
  Gene Name: sex hormone-binding globulin
  ENST ID: ENST00000576152
  CDS Start-End: 1-621
tgggccctgagacctgttctccccacccagagtgcccacgaccctccggctgtccacctcagcaatggcccaggacaagagcctatcgctgtcatgacctttgacctcaccaagatcacaaaaacctcctcctcctttgaggttcgaacctgggacccagagggagtgattttttatggggataccaaccctaaggatgactggtttatgctgggacttcgagacggcaggcctgagatccaactgcacaatcactgggcccagcttacggtgggtgctggaccacggctggatgatgggagatggcaccagctggttcctgccctggatggctgcctgcgccgggattcctggctggacaaacaggccgagatctcagcatctgcccccactagcctcagaagctgtgatgtagaatcaaatcccgggatatttctccctccagggactcaggcagaattcaatctccgaggagaagactcttccacctctttttgcctgaatggcctttgggcacaaggtcagaggctggatgtggaccaggccctgaacagaagccatgagatctggactcacagctgcccccagagcccaggcaatggcactgacgcttcccattaaag

SEQ ID NO: 180909 - DNA, 4002 bp, Homo sapiens
  Payload ID: 15624
  Gene Symbol: SFI1
  Gene Name: SFI1 centrin binding protein
  Uniprot ID: A8K8P3
  ENST ID: ENST00000400288
  CDS Start-End: 106-3834
aagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaagtctcccacttttcatacaaaaatactgtgctact

SEQ ID NO: 180910 - DNA, 3739 bp, Homo sapiens
  Payload ID: 15624
  Gene Symbol: SFI1
  Gene Name: SFI1 centrin binding protein
  Uniprot ID: A8K8P3
  ENST ID: ENST00000400289
  CDS Start-End: 127-3609
ggcgggcgtggaccgcgcgggagttaagaagcaggtcccggatcgccgtataccgccgggttttctcccaacgtcaggcccgatggctcggcttccccagaaggggaagataaaagactttgattcatgaagaatctgctcactgagaagtgtatatcaagccacaatttccatcaaaaagtgattaagcagagaatggagaagaaggttgattccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttca

SEQ ID NO: 180911 - DNA, 448 bp, Homo sapiens
  Payload ID: 15624
  Gene Symbol: SFI1
  Gene Name: SFI1 centrin binding protein
  ENST ID: ENST00000450787
  CDS Start-End: 1-448
aagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtg

SEQ ID NO: 180912 - DNA, 656 bp, Homo sapiens
  Payload ID: 15624
  Gene Symbol: SFI1
  Gene Name: SFI1 centrin binding protein
  ENST ID: ENST00000411518
  CDS Start-End: 150-458
gaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcaggggctcacagtgcagagggaatgacagacaccctgtgagctgatctctgtgatatggtgtcataacattacaggaggggtttgaacagagtgctgagagtacacagctactcactctgtttacattggagaaggttcaggcatttgccggccattttaggcaggaagaataatatgaacaaaagaattattatatgcgtggccagaaagttcttatatttatggattcgaatgacttttgg

SEQ ID NO: 180913 - DNA, 1817 bp, Homo sapiens
  Payload ID: 15624
  Gene Symbol: SFI1
  Gene Name: SFI1 centrin binding protein
  ENST ID: ENST00000417682
  CDS Start-End: 1-1817
tatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagag

SEQ ID NO: 180914 - DNA, 3579 bp, Homo sapiens
  Payload ID: 15624
  Gene Symbol: SFI1
  Gene Name: SFI1 centrin binding protein
  ENST ID: ENST00000443011
  CDS Start-End: 282-3551
gctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccagattttactatgagcagcgattactacggaaggtcttcgaagaatggaaagaggagtggtgggttttccagcacgagtggaaactctgtgttcgagctgactgtcactacagggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctg

SEQ ID NO: 180915 - DNA, 4162 bp, Homo sapiens
  Payload ID: 15624
  Gene Symbol: SFI1
  Gene Name: SFI1 centrin binding protein
  Uniprot ID: A8K8P3
  ENST ID: ENST00000432498
  CDS Start-End: 394-4029
agcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaa

SEQ ID NO: 180916 - DNA, 2625 bp, Homo sapiens
  Payload ID: 15624
  Gene Symbol: SFI1
  Gene Name: SFI1 centrin binding protein
  ENST ID: ENST00000452250
  CDS Start-End: 1-1468
tgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgtatttttgctttagagccctaaaagacaatgtgacccacgctcatctccagcaaataagaaggaatcttgctcaccagcagcatggtgtcacgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttc

SEQ ID NO: 180917 - DNA, 449 bp, Homo sapiens
  Payload ID: 15624
  Gene Symbol: SFI1
  Gene Name: SFI1 centrin binding protein
  ENST ID: ENST00000444859
  CDS Start-End: 212-449
gagttaagaagcaggtcccggatcgccgtataccgccgggttttctcccaacgtcaggcccgatggctcggcttccccagataccgtgttttttacaaattgaaagtttgtagcaagcagccctgcaccgagcaactattttttcaacagcatgtgcccacttcctgtcacttacactttgttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgac

SEQ ID NO: 180918 - DNA, 719 bp, Homo sapiens
  Payload ID: 15624
  Gene Symbol: SFI1
  Gene Name: SFI1 centrin binding protein
  ENST ID: ENST00000425671
  CDS Start-End: 1-173
ctcagattgagcagaaaaaggaaagagagctgctccccttactgcatgctgcctgggaccactacagaatagcactgctgtgcaaatgtatcgaattgtggctacagtatactcagaagaggcggtacaagcaggtttcactttgtcacccaggctggagtacagtggcatgatcttggctcactgcagcctcactctccccaggctcaagcgattctcctgcctcagcctcccaagtagctgggactacaggtgcaagccaccacgcccagctaatgtttgtgttttgtttttttttttgtagaggtggggtgccaccatgttacccaggctggtctcaaactcccaagctctgcctgcctcagcatcccaaagtgctgggattacaggcatgagccactgcacccggcctgctataccattttatataagatacttgagtatccatggattttggtatctgagaggggccctggaaccagtcccccacaaataccaaaggatggctctttgcagaatggcgaatgtttgctaactgttgaagcttgatggtagggtcatgggtattcattatactgtcggcttctacttttgtttacatttgaaaatgcccataataaaaaatagaaaagcaatgtgtagatattatagaaaatttaggaagtataaaaagatataaagaagaaaaaataaaaccattcatgacatttgatgggtaa

SEQ ID NO: 180919 - DNA, 2108 bp, Homo sapiens
  Payload ID: 15624
  Gene Symbol: SFI1
  Gene Name: SFI1 centrin binding protein
  ENST ID: ENST00000524296
  CDS Start-End: 31-1200
ttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagatgcgtggccagaaagttcttatatttatggattcgaatgacttttggaagagtatttccctctaaagccagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagg

SEQ ID NO: 180920 - DNA, 4226 bp, Homo sapiens
  Payload ID: 15624
  Gene Symbol: SFI1
  Gene Name: SFI1 centrin binding protein
  Uniprot ID: A8K8P3
  ENST ID: ENST00000540643
  CDS Start-End: 530-4093
ggaagtgagggagggaggactttcgtacgcagccgcctcccagctggaacctcatctttagtgctcggccgcgggcggcgtaactcggggttccgcctcggaatacctcccacttctcttgtctaagaggagcagtagcaagctgagctcagagcgaagctggcgagccaaggagataaagaaccctcggtggggatgcccagagggtgcatgctccacgcccctcgaaaccgattctcattgctgctgctgcaaagcaacccgaagtgcgccacctacccgactgaggctgcgcaagccccggggtctgggcggggtggtcctcgtgcgcgccgcgtcgccgtggagacgagggcgggcccgcgcgagactggcgtctagaggcgcgcgaagcgctgaggcgggcgtggaccgcgcgggagttaagaagcaggtcccggatcgccgtataccgccgggttttctcccaacgtcaggcccgatggctcggcttccccagttagaaggggaagataaaagactttgattcatgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcagattttactatgagcagcgattactacggaaggtcttcgaagaatggaaagaggagtggtgggttttccagcacgagtggaaactctgtgttcgagctgactgtcactacaggtattacctgtacaacctgatgttccagacgtggaagacctatgtgcgtcagcagcaggagatgaggaacaagtacattagagccgaggttcatgatgcaaagcaaaagatgcgacaggcctggaagtcctggttgatctacgtggttgttcgtaggaccaaacttcagatgcagactacagctctggagtttaggcaacggattatcttacgggtgtggtggagcacgtggaggcagcgactaggacaggtccgtgtgagccgtgccctccatgcctctgctttgaagcacagggccctgagcctccaggtgcaggcttggtcacagtggcgggaacagctcctgtatgtccagaaggagaaacaaaaggttgtctctgcagtgaaacatcatcagcactggcaaaaacggagatttctaaaggcctggcttgaatacctgcaagtccgcagagtgaagagacagcagaatgagatggctgagcgattccatcatgtcactgtgctccagatatacttctgtgactggcagcaggcctgggagcggagggagagcttgtacgctcaccatgcccaggtggagaaactggccaggaagatggccctgcggcgcgcctttactcactggaaacactacatgctgctgtgtgcagaagaagctgcccagtttgagatggcagaagagcaccacaggcacagccagctgctgctgcacaggttctggaacctctggcggtctcagattgagcagaaaaaggaaagagagctgctccccttactgcatgctgcctgggaccactacagaatagcactgctgtgcaaatgtatcgaattgtggctacagtatactcagaagaggcggtacaagcagctgctacaggccagagcggatggtcatttccagcagagagccctgcctgctgccttccacacatggaacagactctggcgatggcgccaccaggaaaatgtcctcagtgcaagagcaacacgtttccacagggagacattagagaagcaagtattttctctctggaggcagaagatgtttcagcatcgagaaaaccgcctggcagagagaatggccatccttcacgcagagcgacagcttctgtataggtcttggttcatgtggcaccagcaggcagcagcacgtcaccaggagcaggagtggcaaacagtggcctgtgcccaccaccgccacgggcggctcaagaaagctttctgcctctggagggaaagtgcccaagggctcagaacagagaggacgggcagggtgcgggcagcagaattccacatggcccagctcctgcgttgggcctggagccagtggagggagtgcctggccctgcggggagcggagcggcagaagctgatgcgagcagacctgcaccaccagcacagcgtgctgcacagggcgctgcaggcatgggtgacttaccagggcagggtgcgaagcatcctccgggaggtggcagccagggagagccagcacaacaggcagctgctgcgcggggcattacgtcgctggaaagagaacaccatggcccgagtggatgaagccaaaaaaacctttcaagcaagtactcattacagaaggaccatatgttccaaggtcctggtccagtggcgggaagctgtgtcagtgcagatgtattaccgacagcaggaggactgtgccatctgggaggcccagaaggtgctggacaggggctgtctgcggacctggtttcagcgctggtgggactgcagccggaggtcagcccagcagagactgcagctggagagggcagtgcaacaccaccaccggcagctgctgctggaggggctggcccggtggaagacgcaccatctgcagtgtgtcaggaagaggctcctgcacaggcagagcacccaactgctggcacagagactcagccggacctgcttccgccagtggagacaacagctggcagccaggaggcaggagcagcgggcgacagtgcgggccctgtggttctgggccttctcgctgcaggcaaaggtgtgggccacgtggctggcctttgtactggaaaggaggagaaagaaggcgcggctgcagtgggcgctccaggcctaccaggggcagctcctccaggagggtgccacgcggctcctgcgctttgcagccagcatgaaggcctcccggcagcagctgcaggcccagcagcaggtccaggcggctcacagtctccatcgtgccgtccgccgctgtgccacgctctggaaacagaaagtgctgggccggggcgggaagcctcagcccctggcagccatcgcacccagcaggaaagtgacgtttgagggtccccttctcaaccgcattgctgctggggctggggatggcacccttgagaccaagaggccacaggcttctcggcctctgggagctctgggccgcctggctgctgaggagccccacgccctggagctcaacactgcccactcagcgaggaagcagccgcgacgcccacacttcctgttggagcctgcgcagagccagaggcctcagaagccacaggaacatggcctaggcatggctcagccagcagccccctccctgacgcggcccttcctggcagaggccccgacagcactggtcccacacagccccctgcctggggccctgtcaagcgcccctggcccgaagcagcccccgacggcaagcacaggcccggagctgctgctgctgcctctttcctccttcatgccctgcggggcggctgcaccagccagggtgtcagcacagcgggctactcctagggataagcccccggtcccctcatccctggccagtgtccctgacccccatctactccttcctggggacttctcagccaccagggctgggcctggactttcaactgcaggcagcctggaccttgaggctgaacttgaggagatccagcagcaactactgcactaccagaccaccaagcagaacctctggtcctgtcggcggcaagcgagcagcctgcgcaggtggctggagctgaacagagaggagccggggcctgaggaccaggaagtagagcagcaggtgcagaaagagctggaacaggtggaaatgcagatccagctgctggcagaggagctccaggctcagcgccagcccattggcgcctgcgttgcccgcatccaggccctgcggcaggccctgtgctagcgtgttcgcaccaggaacgcaggtgctgggctgtcggggaggcctcaggccacctccaggaacagaacacagttttaagtttgattttttttatttcaaaatgctttgcaattaaatgaattactgttcagaa

SEQ ID NO: 180921 - DNA, 309 bp, Homo sapiens
  Payload ID: 15624
  Gene Symbol: SFI1
  Gene Name: SFI1 centrin binding protein
  ENST ID: ENST00000629688
  CDS Start-End: 1-309
atgaagaatctgctcactgagaagtgtatatcaagccacaatttccatcaaaaagtgattaagcagagaatggagaagaaggttgattccaggtattttaaggatggtgcagttaagaaaccttattctgcaaagacactgtccaacaagaagtcttctgcatcctttgggatccggagggagttacctagtaccagtcatctagtgcagtatcgtggcacacatacttgtacccgacagggccggttaagagaactgcgcatcaggggctcacagtgcagagggaatgacagacaccctgtgagctga

SEQ ID NO: 180922 - DNA, 1079 bp, Homo sapiens
  Payload ID: 15625
  Gene Symbol: SFT2D1
  Gene Name: SFT2 domain containing 1
  Uniprot ID: Q8WV19
  ENST ID: ENST00000361731
  CDS Start-End: 111-590
gggcgggaccggacttccggctggtctgtggggtttcgggttcggggtttcctggtgggcgtcaggggcaggcaacagagtggcggccgctacggccctgtaacagggccatggagaagctgcggcgagtcctgagcggccaggacgacgaggagcagggcctgactgcgcaggtcctggatgcctcatcccttagtttcaacaccagattgaaatggtttgccatctgcttcgtatgtggcgttttcttttctattcttggaactggattgctgtggcttccgggcggcataaagctttttgcagtgttttataccctcggcaatcttgctgcgttagccagtacatgctttttaatgggacctgtgaagcaactgaagaaaatgtttgaagcaacaagattgcttgcaacaattgttatgcttttgtgtttcatatttaccctgtgtgctgctctttggtggcataagaagggactggctgtgttattctgcatattgcagttcttgtcaatgacctggtatagcctgtcgtacatcccatatgcaagggatgcagttattaaatgctgttcttctctcctaagttgaaaatcagaaacttgtggaaaagagcacttgaatgttggtactctatgtttggtgaagtttgcttttccccataaaacactccaggaacaactgacgtgacagttgaagaccgttttgtactaagtctcattttgtatactggtaaaaactacatgcttgattaaaccattaaatgcttgtaactttaaattcattatgtgtcattaatatacttttccaaagataagatttttaatcactgccagttgtaaattatttttagccaatttttaaatcttttcaaagcagctttgaaatgtgaatatttaaaggtagacctgtgctgcaagataattaaacttttttgcttttaaaaaatgtctgcatttttaagattttttttactttaaatgtgaaacttattttaagctaaaaattgcttattatatgtaataaaaataatatataaatctttacaattttgaaataaacccatccttggaaaaataa

SEQ ID NO: 180923 - DNA, 11040 bp, Homo sapiens
  Payload ID: 15626
  Gene Symbol: SFT2D2
  Gene Name: SFT2 domain containing 2
  Uniprot ID: O95562
  ENST ID: ENST00000271375
  CDS Start-End: 73-555
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagtaccatcttcctcatgggaccagtgaaacagctgaagcgaatgtttgagcctactcgtttgattgcaactatcatggtgctgttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctgattctgcgcctgactgtggaatgtattttctgacattaggtgcagactctttttctcttgggttttatttcccatccctccctccctctccctgcatatctttctttatgacctcctggcactagatggggaaagaacagagcagcagcagaaaatgctgctgttttttttttggacgagagcccataggagttgaaaaatcctgctgctctcagctatatttttttctccattatttataaatgtttgcttttaaactgattttattttccattctcccctggagttgggccaggggagagtggggtgggaagacagatccctgctgtgcagccagcaggaagtaggcacgcctgcccagtgacctttaaatagtcccagtgtttgcacttagcctgtgctggggacactggggataaactgcaggtggtctcatgtcagcctgatgcctaacctacaaagtgcttttgtgtccacgatcttacctggttcttatggagagccttgtgaggaagcagggattgttataccactgtgcagtcaagggaatcaaggcccacactggtttttggatccacccaaagccacagcttcagcctccttcatgaccccagagtttcctggcctgtttctggttgtgcctcctgtaactgcctgtgactgtttccctcgttttcatcagccaagccatctcctccctggccctccctgcccatctcttttggaagcttcttcctggatctgcaggatgttcactgtcccttgtgttccctttcagctcctccttgttgcctgactacgattagtgccctgtcttgtcagccagcattcctggccctccaggacctccagagtcatcctacaaatgacgtttatctggattgcctttctgttctttgcacagggccaactggtccactagggctcctcctctgtcactgctaaaccaaaggaagtggcctgctggttgtcccctttcttgtggctaattgctgaacctttctttgtcctactgtggctaagaactctgactggtttttttttttttttctttttgagatggagtctcactccgtcgcccaggctggagtgcagtggcgtgatctctgctcactgcaacctccacctcccgggttcaagcaattctcctgcctcagccttccaagtagctgggattacaggtgcccgccaccacgcccgtgctaatttttgtgtttttagtggagacagggtttcaccatgttggccaagctggtctggaactcctgacctcaggtaatccgcccaccttgacctcccaaagtgctgggattacaggtgtgagccactgtgccctgctgatcttttcttctgaggctggggaggtgtgaacaagcctgacggggccagagagaggagctagtcttcccaggttctttctaggctattgatgacatccagtcatctgctcaggtcactaacctgtcctcagccaggaaaggaaattttatgctacccctctggcttttgtgggattctttcacatcccaggtgcctcttggagacagatctcagaagggctgtggtgtcagaagggacatggaggaggtcaggagggctcatggttccttttctttagaactgatacgaggcttggctagtcactgtgagctccagcagctccagcagcctggaataagacacctagaaggctcatccctccatgtccatgtcctttttttttttttagattgaacaaccatgctttgtttaaaaaataatctcagcaaactagggatacaagagaatttcctcaacctgtcgaagggcatctttaaaatatctactgctaacatcctatgtaatgatgaaaggctgaatgttttcccctaagattgagaataagacagagatgtcaactcttaccacttctattcaacgttgtactgaaaattctagccactgcaatcatgttttaattgggagtagggggaaagagggagggaaggagaaaaatgaaaggcctttagattgaaaagaaatgagtaaaactgtctattcacagatattatcatctatgtagaaaaccaaatcaaatccattactaagttactgaaaccagcaagtgagtttcgcaacacagcaggatatataattgatatacacaaatcaattgtgtttctccatgttagaagtaaagaattaggaattgaaaatttaaaaataataccatttacaatagcattaaaatataaaattcttgggaataaacccgacaaactatgtggattatctgtacactgataactaaaaagcattgctaagaaaaattaagacctaagtaaatatcttgttgataggttgagagactcaacattgttgatgttaattctttcccatattaatctatagatataatgcagtccccatccaaagccaagcaggcttttttttttttttttttgtagaaattaaaaactggttttaagattcacatggcatgcagatgatctagaagatccacagtaactctcctgctgtgcagctggttcctaacaggtcatggacctgtccatggcctgtaggttgggaacctctgctacagaggatccagatttaaattcagaagaagcttcatctatttctgtagtttcattttcttgcaataactgctgcatcaaacttgaacttcgcaggattttctgaagctgctcaatttggccatcttgctttttaattgtatttcttaacactagaattttctatttcaagtttttgtacgtggccttgcgtctccttagtacattttatagtcgctgtaagttgattccatttttcttgaaattgaattctcatctgacctaatttcttccttgaatcctacatctcactttctcaatggacgcagtgacgcaatgaagcatccagcaaagcttttgttgttgattgtttaggacgtcaccctgtttttgttgaagttgtctcacaactacttctctttctgctttctctctttcatattgacattgtttttctttcaaatgattaactttattgatcatcctcttgttcttctagcaaaagacggtgctttatgcactcagcttgaagattttgtgctgtagcatcacatttggcttgactatcaattactgttttttcttgattgtcagctttgttgtgaacatcatccagttgctgttgaagcaacatattttgtcttcgtagttgacataatcttacttgcttttctgtgcatttttctactttatcttggccacttgtgtacattttttcaatgtccttcatttgacaccgtttggtttagctctctttgtatgtgttcaaaaaccaaagcgttttctttcagagcctctcttgtgttatggagctcagttttgaggcacctggacttactctcagctttagaaagttgctgagaaagaatcagaacatgagaattcaaattttcctgtaaatgacgcaatttatctactgtgccctggaaatcaagctcttggtctctttctgttgagtgactttgatcatgatcatgtagagcaacattcagtctacgatggtatgattccatttcgtcagtctttgcctgctttgtttttccttctccagtttagaacggagcattgtgttctcatctgtcagagcagtaagctgtccactataatgggctatcgtttttgttgatttttccccattctgttttagagccttttgaaggtcttcatgctttctttttataatttcaatgtcttttaagtatttcttttccaggatttgattttttattgtgtgtatttccagcctgagcctggcaatttcatcttgcatcaaatggtttttatgcaacaggtcttcttctttttcatgactatcagaaatctcaaactgcagagttcttgttcccattcaagtttttgatattctgtgatatttcttttttttcagatagtctcttttgtagtacactagtctttttcattttttaatttttactgtaagtcactcagtgattatctttaagttccactgatcttttacataaataaactgcatttttaattttctttttttatatgagattctggaaatacttctttttttaaattatactttaagttctggggtacatgtgcagaacatgcgggtttgttacataggtatacatgtaatgttatccctcccctagcccccacccccggacaggccccggtatgtgatgttcccctcccttttccatgtgttctcattgttcaactcccacttatgagtgagaacatgtggtgtttggttttctgttcttgtgttagtttgctgagaatgatggtttccagcttcatccatgtccctacaaaggacatgaactcatcctttttttatggctgaatactattccatgggtgtatatatgccacattttctttatccagtctataattgatggacatttgggttggttccaagtctttgctgttgtgaacaatgctgcagtaaacatacatgtgcatgtgtctttatagtagaatgatttataaccctttgggtatatacccagtaatgagattgctgggttaaatggtatttctagttctagatccttgaggaatcgccacactgtctttcacaatggttgaactaatttacactcccaccaacagtgtaaaagtattcctatttctccctgtcctttccagcatctgtggccaccatgccactttttaatgattgccattctaactggcatgagatggcatctgatggtggttttgatttgcatttccctaatgaccagtgatgatgagcattttttcatatgtttgttggctgcataaatatcttcttttgagaagtgtctatccttcgcccacttttcgatggggttgttttgctcttataaatttgtttaagttctatgtagattctggatcttagccctttgtcagatggatagattgcaaaaattttctcccattctgtaggttgcctgttcactctgatgatagtttcttttgctgtgcagaagctctttggtttaattagatctcattttgtctattttggcttttgttgccattgcttttggtgttttagtcgtgaagtctttgcctatgcctatgtcctgaatggtattgcctaggttttcttctagggtttttatggttttgggtcttacgtttaagacttcctcttttcctaattgaataccctttatttctttctcttgcctgattgccctggccagaacttccagtactatgttgagtaggaatggtgagagagggcatccttgtcttgtgctggttttccaagggaatgcctctagtttttgcccattcagtatgatattggctgtgggtttgtcataaatagctcttcttattttgagatgcgttccatcaatacctggtttattgagagtttttagcatgaagggctgttgaattttgttgaatgccttttctgcatctattgagttagggaggattccctctttttctattgtttggaatagtttcagaaggaatggtaccagctcccttttgtacctctggtagaattcggctgtgaatccatctggtcctggactttttatggttggtaggctattaattactgcctcaatttcagaacttgttattggtctattcaggaactcgacttcttcctggtttagtcttgggagggtgtatatgtccaggaatttatccatttcttctagattttctactttatttgcgtagagttgtttatagtattctctaatggtagtttgtatttctgtggtatcggtggtgatatcccctgtatcattttttattgcatttatttgattcttctctcttttcttctttattagtctggctagcagtctatctattttgttgatcttttcaaaaaaccagctcctggattcattgtttttttcgtggtctctatctccttcagtcctgctctaatcttagttatttcttgtcttctgctagcttttgaatttgtttgctcttgcttctctaggtcttttaattgtgatgttagggtgttgattttagatctttcctgctttctcttgtgggcatttagtgctataaatttccctctacacactgctttaattttgaaatggagttttgctcagtttcccaggctagagtgcggtggcatgatctcagctcactgcaacctctgccttctgggttcaagtgattcttgtgcctcagcctcccaagaaactgggactacaggcatgtgccaccacacccggctaatttttgtatttttagtagaaacagggtttcaccatgttggccaggctggtctcgaactcctgacctcaagtgatcctcctgcctcggcctcccaaagtgctgggattacaggcgtgagccaccatgcccagccccatgtcctttttaatgcctggattgactttgtgggacatgaggccaaggtaccttttaagatgtcacctgtatagcatactagtagtgaatgtaggctttgaagtcagatgcatctggctgtgagctgtgactagtcatatactagttgtgtcattttgaacaggttacctaacctctggctcctcagtttgttcatctgtttaaaaattgtgggaataacagttcctgctgggtcattgcaagatgtcagtgagacgtgtcaagtgcttagaatagggcttggcataagtagagtctcagtagggtaggtgttatttaatcccagaaataactgacaactttggaagatgagagtgaatgtctccgatcattaatttatttaacaaatacttatctagtactatgtgcccggcgctgtagacactgccatgttttatctcattcaatattcacagtgactgcccagtgaatggtattgcctccatcctctgagaaggtaaagagcctatcccagaccccacgagtggaggcgtcagggaggggttcttggcaggagatgggtcttgtagaaaggcttctgctttgctttcactcacggcctgtggccagtttgctcagacagctcccatcaggacaccattggcagcttttgcatgaccctgcctcccagggtcttcctgcgtttttccttaagttgccttattctttggttgtttccctacttgtttttgttagactgtgggaggaagaaatccatttcaaatctgctgaaacctgttaccaagcaacagcagtgattaaaagcaacctgatgagtgagtaaagaattagggtttcagacctgtagttaatgatggtctctgtctccctgctgccctgcattcccttcccttccgttcactgctgggtgaaggagggcttgctgcattttggaagttaagggaaccaataaggtgactcttttgcagattggaatatggtgctcagccagccatatggaagcactgtcctggcgtgatctgccctgggctgttggctctctgagtgctgtcttgggaggagcactgcccttcagaacagaagagatggcttccagtcccctctcccccttctcccagtctctctgaggctgcttgttgggtattgggcgtgctgtgtactaactcactcccgtctcttgtctcattatctgaaatgcatccccttttgcagaaagggctcaaacggagccttcagttctgctcctctgcatagccgtagctcagatcctagctcaagatgtcttgtctgggaagggcaaaacatggtccccagtgtagcattttcactgggttgattatctcagtggtggatcatctatcacccttgtgtggtgactttgtgaattatctgcctgagtgccacttcccttccaccctaatcactgcaggctcagggagcaagaaataaaatcatgaaatgcattccaaataaaattaccttttggctgggtgcagtggctcacacctgtaatctgagcactttgggaggctgaggtgggtggatcgcttgaggtcaggagttcaagaccagcctggccaacatggcaaaaccccatctctacaaaaaatacaacagcaaaaaaatcagccaggctagctggtgtgcgcctataatcccagctacttgggagggaggctgaggcacaagaattgcttgaacccaggaggtggaagttcagtgagccgagatcgcacccctgcactccagcctgagcaacagagtgagactctgtctcaaaaataaataaaaaaaaaaatcactttttgatacttctgttaaaatagataataaggaaccatatcttaaagtgtggaggatctggcttggcttctgtttttgatagctctatgaaagtgacagatttgcatcatgagacttagtggaatgaattgggaaattgaagggcagcccagtggctatggattctattttctatgggactgtctacgccaggctttattttctctttgctcagataacttctgactagagtcgacggtaggattataaatggtttaaaatacgtattctcaaacctcattttcagcatataaatttttaagaatcagtgtttaaaggtacgtgaaaccatttgctagatttttgtcctagttttttttttttaatttaaaaatcttaagttttttttagtaagcttaagatgtccagtagtttatttgcagacagcatttttaaaaagtgaatagatgtttaactgaagttaaatacaaatttatgtctgtgtaactcttggtaagatataacaaaacctagacatctaaattttttggaaatttttattttaaaagtttgttgggaggtaaaattgtgtgactttaccttctggttaatagttttatagttaagaagaaagtccagcgaagtttacttgatctcagttgcactcaagaataggggatttagttccactttggttattttcacttctaccctaaattcatagtccctgatacttaagctttacccttggcttaccagttttcattgcagcgagtaaatggggagtagcagagcctttgttaatgtaaattgacaaaaagtatgtccttttctagcaggagcagataaactgataatggtcttagaaatgtagaaaatgattttttgtagacaggatgatctgtctagattgtagcaaatgatggtacatattcacaacaaagttgtgccactacatttaataaacagccacaaacaacaaaaggacaactggtccccgatataaatggactagctacctggacataatatccttgtgaggcatccttaaaggacaaattgcagctggtatttgggtgaatgttgttgctctgtgcctgttgaatgtccatgctacaagaagttatgagccttgttctaagtacagatgaaccttgtatttgtgtaatctcccaagggagagctatggtttacattcaattttttggtctttctgctatgaaacgtgtttattttgcctctgtcaatgtgtttgcaaccttaagtaaggaaagggaaaaaaaaaatagccctctgaactctgatcttttgccgcttctgtagattttgattgtgaagttgggagtgaggacattcaaaagcccatggtgaatgcatatgcctttagaatattgtgcctgttttaaaatgtttgagcttttaaaatacgttgttaaaacatgaatccatttttgtaattgtataaatactcataactaattttgaatgctactgattgtgtaactgaatttttgtatccaaaaatacattcttgagtactacttttcctaccttgaaaatctatttcatttactaaatattgttttctttatgctaacttaactttaaaaggaatgttgccaagctgtctctcctcccccatcacaattgttagttttttttgctttctttcttcaataaatgatagcattatgatctttaataaa

SEQ ID NO: 180924 - DNA, 491 bp, Homo sapiens
  Payload ID: 15626
  Gene Symbol: SFT2D2
  Gene Name: SFT2 domain containing 2
  ENST ID: ENST00000367829
  CDS Start-End: 131-457
gcctgggcggggcgcgccgcggttggcgcctgggcggctgggcggctgcctagcacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagttgtgttttgcacttaccctgtgttctgccttttggtggcataacaagggacttgcacttatcttctgcattttgcagtctttggcattgacgtggtacagcctttccttcataccatttgcaag

SEQ ID NO: 180925 - DNA, 1073 bp, Homo sapiens
  Payload ID: 15626
  Gene Symbol: SFT2D2
  Gene Name: SFT2 domain containing 2
  ENST ID: ENST00000630869
  CDS Start-End: 73-399
ggaagagccgtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctcttcgcagtgttttatacctttggtaatatcgcatcaattgggagttgtgttttgcacttaccctgtgttctgccttttggtggcataacaagggacttgcacttatcttctgcattttgcagtctttggcattgacgtggtacagcctttccttcataccatttgcaagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctga

SEQ ID NO: 180926 - DNA, 3735 bp, Homo sapiens
  Payload ID: 15627
  Gene Symbol: SFT2D3
  Gene Name: SFT2 domain containing 3
  Uniprot ID: Q587I9
  ENST ID: ENST00000310981
  CDS Start-End: 22-669
tctgccaccgccttgtccaagatggcggacctccaccgccagctgcaggagtacctggcgcaggggaaagctggcggcccggcggccgcggagccgctgctcgccgcggagaaggcggaggagcccggggaccggccggcggaggagtggctgggccgcgcgggcttgcgctggacgtgggcgcggagccctgcggagtcggcagcggccggcctgacgtgcctcccgagcgtgacgcgcgggcagcggctggcggcgggcggcgggtgcctgctgctggctgcactgtgtttcggcctagccgcgctctacgcaccggtgttgctgctgcgcgcgcgcaagttcgcgctgctctggtcactgggctcggcgctggcgttggcgggaagcgcgctgctgcggggcggcgcggcgtgcggacgcctgctgcgctgcgaagaagcgccgtcccggcccgcgctgctctacatggcagcgctgggcgccacgctgttcgccgcgctgggccttcgcagcacgctgctcacggtgctgggcgcgggcgcgcaggtggccgcgctgctggccgcgctggttgggctgctgccctggggcggcggcaccgcgctgcgcctcgcactgggtcgcctgggccgcggcgccggcctcgccaaggtgctgcccgtgtgaggacctcgcgccctcgccgctggggaagtacgcggagccagcgccgtcggagaccgcgccggccgagctgaggactgcacgccgctgtgcggaagcccgtggcgaaggccctgccctaacagcctgcgagtctaatccgggagcggctgctgccagcggaggcgacagcagcgttgggagctcctcgatgtcagctttttgtgctggacttggcacacgctctgaaaactgagattttgtcattgaactggtgacaggatgtgagacggttattagaagttgctttcgaagtaactgtggtcttaggttcggctgagtaaagaaaaaggatttttcttcgagttagctgctcttgtgatttttctcaggctgttttgtcattttaaaatccagtggtagatgtagcttagcgacggtagttttttgttttggctatactaagacttggaaattattctctccagtgtcagcgaatccagaagggtatcagattaaacaccgaattcagccactggacttttaaaagtacttaagatggtttatctcgggttttttcttcagttaacaaaatcataaatatggtgccttataacatgaaaggaaaattagttgtgtatttcacgacgaaagcgacggaccaaaagaaatttcctgccccaagaagcatgggatccaggaaggggcgcgtagatgcttaacggtctcttcggaaatcctgcaaatagaaagataattctagatccggaatacctgtatctggtggaaaccatggatttctacaagctcgaattattcctcattgtatagcctgctttgtaaactagtttacaatttgcaggctgatcttaagatttttttatatctaattgctgctgccttcattttaggttcagcagttacttttaactaccttaatttattgccagaaggtatgagcctaacattctgatgagtccagaaaactacgttttgtcagtagcaatacactaggaagtaaaatatatttagaatttaaacattgtgtgccagtggtcctcgcgcttgactgcacatcagttacttgaagagccacacctcagatcaatgcagtcagaacctgggaagtaggtcccagacatcaggacctttttaaagctccccaagtgattctacgttccccaagtttgaggaccacttttctgtgcattggcttgcacaatttgaaagtaatgcttttcctgagctggatcccagtgttgccttaacagggtgtctgtcgtgccgcagtagagcactgctgcttcctccaaccccaaaatttatgttcctaagtaagtcaggtccctaagccccgtcccaagaagtgacacaagtggccaacatccacactgtaggcttgcaggctacccgccctgagatttggtaaagaacactgccttgttccccatcagtaaacaaggttacctacctcaggaggctgcttgtgagagagcaaatgcagtatcttcagaatgatttatttttttaattaattgtaaagacttgtgccattggctgctctttctagtcccctaaatttctgttctagttttaaatttctctagaacttgcaatagttgggggttttataatgatgttttacaatgtttatttcttaaataaaaacttaaaaattcaacatttctcagctggtggctcacacctgtaatcccagcattttgggaggccaaggcgggaggatcacttgaggccaggagttcaagaccagcctgggcaacacagttaaaccccatcgccacagaaaatcttcaaaaaatttgccagatatggtggcacacaactgtgatcccagctacttggggtggggctgaggtgggaagatcacttgagcccaggaggttgaggctgcagtgaactgtgatcacaccactgcaccacagcctaggcaacagcgagaccttgtctcaaaaattttttctcaaatcaaacatcattgaaaatctactttttataagcttcaaatcacaacatctagtatgtatgctgacagtgatgtttttaaatgccatatatatttaataagtataatgtagaggtttattgtttaaatgaattcactctcaaaatgtgatctgtcaagtccagtagagcttcaaggtaaaatgaaaatttttaaatgtgatctggttatctgcttactgagatactatgtttctaaagttaaagcccaaaataatgaaaatttttccactagaatctcagggaaaaaaagtctaatcttgatatgggtttggtctctggatccggttttagcttcatgaaatttgattacagtttctctctctttaagctataccagttgggggtgagtgaagaaatacccataacctaaagcaatcttgagcctcctaatagcatgtttatggtggagcgctgattaaataagctgtaatttcaaagttaaaaaaaaaatagtctctagattctaacactgaaaagcagtgtatatggctgacattttctcactccacagaaatcaattagcttttgctgttttttacattcatagagaaccagttaaattttcatatcctgttaaactatatcagtatgccttttctaagcaaccattgaaacttccagcaccagcggccaggtactgtggctcagatctgcaatcccagcactttgggaggccacagcaggtggaccgcttgagcccaggagtttgaaaccagcatagacaaagtggtgaaactccatctctacaaaaaacacacacacaaaaaattagctgggcatggtggcatatgcctgtagtcctagctactagggaggctgaggcagggtcaaagctgaagtgagccgtgattgcaccactgcactcctggctgggtgacagagcaagactctgtcaaaaaaggaaaagaaaaaaagaaacttccagcaccactaaatttgccaaataaatttgactgatgccaaaactgaagctgccaatgtaatgaaatgttaaggtggccataggacagtccttttaataaaagcttccatgtaaaaccaaaataaaggtcagtatagaaagta

SEQ ID NO: 180927 - DNA, 14131 bp, Homo sapiens
  Payload ID: 15628
  Gene Symbol: SUGT1
  Gene Name: SGT1 homolog, MIS12 kinetochore complex assembly cochaperone
  Uniprot ID: Q9Y2Z0
  ENST ID: ENST00000310528
  CDS Start-End: 56-1057
gaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatagtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattcacctaatgcccattgtgtattgatattgcattcttgaattttgaacactgaatatctttttgaaagattatacttctttacctctttgtgctttagaaattattttccttcaagtgttcaagtctaatgaagaatgaagataacattttatcacttctgtccttaaaggtttcagacatggtgaaactgaataaagcatgtcatttgctcctagatagattcattctatctagttgtggggatggagaaatctttaatggtatattttcggttattgccttatttttgatacagtattctgtcagtaatttattagacctggcagctttgggtgagcttagatttttcaccttcagtgttacattgtgtttgcttttaaaaactgcttttgaatggagttgtaaatacaatttttctatgaagatgtttggtttatttacctttttcttaagtttttaatgagaactttgagaaattatcacagggaattcccatgtagttcttttaatgggaagaatttgtaaatttaattgcactgagatattttggtcgttaccttgcaagtttctgtataaaacatagatacctgagttttaacacactgcaagtttatactaaggataatctgtgaaggtagggcaaagaaggttctaggaaagcccaactccacttgcttcttttatcacgacaggattcttgaaattacagcattggtgggttttttggtattttttttctttattagaaaatctctgttgtcacgtccccatgattactttggtttcattggtttatggtaactgctgtgagagtaaattaatgtgtatatgtttagtatttactctgtgcctagaatatatagatatcatgagaatacaaaaaattaaagacatgattattaacttcaaagagcttataaatgtagcagggaaaaaaaataacattcatgaaggaactgtggaaagattgaatgctgaactcggtataaatacactttagagacaggaaaatgttctgtgattaaaattgtttacagtctaggctgttataaagtatagactatggatgacctgtagatctgactttgttttctcaccatgattttctcaactgtaataccccagatgttggtctcagctctgttaggtgtcactaacatttttatggcaaagcactactctataccctcagagcagggggagtgggaggcaaacgggtcatcatttcagcctccaaaacagtaggaattcagctccttccttctcgtcctttgttgtggggtgtaggggagttactaaggaaagtttcagtaaggtgataccagatggtgcccaaacctgttgttatagcttgtttaagcattctagagttttcacttgtccttctgtccacttagagctactagatacatttttttcttcttgaacactgaaggaaaaggcaaaattaagttttggttggatggatttctaaagttttcttcttaggaaaataggatagtgacttttgtattctgtatgttaaattttctcagtaccattaatcctaagatgaagaggaaggctattgctgcagaggcatagttgaggacgtatagcactataccagagacaagaatgcttagctctagcaagtcttctgtcattgactaccttcataatcttcagcaggtttaggcctttcttagttcctttgtaaataatccatagagtcttagagttataattaaaggtccatggttctaaatacagaagcatatttttgccgcttaactttttctttcttaaagatgacactattaaaatagctgtttctgaccaggtgcagtagctcatgcttgtaatcccagcattttgggaggcggaggtgggcagatcacctgaggtcaggagttcaagaccagcctggccaacatggtgaaaccctgtgtctactaaaaatgcaaaaattagctgggtgtagtggcatgcacctgtagtcccagctacttgggaggctcaggcagggagaattgcttgaaccgggaggcagggggtgcagtgagccaagatcatgccactgcactccagcctgggcgactccatctcaaaaaaaataaatagctgtttaaaaaaaaaaaatctggtactatctttagttggttttaaaggatatattatctagaatatgcttacccattggctagatttgctaagtgttgtgggatttgggattttgctggtctgaagggagtttgtaaaacacatgactgaaagcattataaaacataccttgtcaaatacattagattcattataggtcaagggaattttgaaaagtaggctagattgctgcctaagaatcccactctaaagtactgctttgtttaatcattctagataatggaagcttgtaagcctccagaaagttaaaacaaaaaacttctttctgattaagagcctcttaactctatccttatcctctgctatctcaatgtagctattaattgttccctctttgtttctagactccaattttcatttctcaaattttggttctcagtgctgttagtattagtagccttttgtttcttcagaatgtatgtatttttcctcttaaatgtttcctttcccttttaaggttagtcctggaatacatgtttttcttggtcttgtagacttcatctcttctgatttccataataatttgcaccttgatgaatccagaattctcccactgtcttcaaagaatcttgaatagaataatctgctttttgaactctgctatctagtaatctctttagatatctataccacaagtttgaaacatcaaggtcaattttgataatttcctgtcttatgtcttaatacccattcagagttgactgccaactaacaagctcagcctttagcactggcacttactggccaatctgttttctgtctatagggagtgaaatggaatggagaaagaggatggcttgcattaataactctagtttttaaaaacatttttattccttttttaaaaatttgtttagagacacggtcttcttctatcacctaggctggagtgcagtggtgcgatcatggctcactgtagcctccaactcctaggctcaagtaatcctctttcctcggcttcccaaagtgctgggattacaggtgtgagtcactgtgcctggcccacattttcattcttggctcactgtagccttaatctttcaggctcaaatgattctcccatctcagcctcccaagtagctgggaccacaggcatgcatcaccacgactggctaatttttgtattttttttgtagaaccgggtttcaccatgtgcccaggctggtcttgaacttctgggctcaagttatctacctgcctcagcctacccaaagtgctgggattacaggagtgagccaccatgcccagttatgaacttcaagtaaatatttaaaatggagatacatcacaatgctattatgaataatttagatagaaattttaatttagttcagtacttaaatattttttggctcttctttcccactttacctttctctattccttcctcagttatctacatatcagattagattattgatatctgagatatatcactgacccagagcaaaattgcatattagtttaccatctaatcagcctaatgcacttaaattcccttggaatctttcctgttcagattggtgtgcatctctctgaacttgtagctttactgacatttccaaaaaaaggtagacggtttctaggtggtgtgtgtttttgttagttactagagccacttaccctttgtaactagctctaaagaagtacatcttttgctcatacctgctactgtaaccatatgacagtatggatttaagttatttctgcctagaggaattagatgataaaagctaaaaggacaaaatactggtttctgtgcagggaagggtcatatgtagttttaaataaaagggttcatctcttttgatgtggtttccctttctccatctgtgcattttttaaatcgtaagatcattttacacacaccaagagattttattttgggaacttgtggggaaaatattgatttacctacaaatgttactatttggagccatccttgtgattggtttctgagattaatttaactcttagcctcacttcctaccttagtaaagttgctcctccaaatcagctaaaatcatatacaatgaatgctgactcattactgcaaatagtggtagttactgtgtactagcatttcttatggattgggtggcattatctcatttttaatcgcccttcaatagcatcccattattgcaaatcagaaagatgatggggccaaagtaaagttctttgcccaggtcactctactagtaagtaattgcaatagctgggatttgaacccaggcctatcagactccattacccatacttctgacaactgcaatcctctcatcaggttaataagctagatgtggaatgaatgatttttattaccaaatcagctgactggaaatgaagcagagaatattcaagttaaagaactaattctttttttttttttttttgagacagtctcactctgtcgttcagggaaggaatgcagtggtgcaatcttggctcactgcaacctccacctcccaggttcaagtaattcttctgcctcagcctcctgagtagctgggattacaggcatgggccgccatgcccagctaatttttgtatttttagtagagacgaggtttcaccatgttggtcaggctggtcttgaactcctgacctcatgatccgcccaccttggcctcccaaaatgctgggattataggcgtgagccactgtgcccagccaagaactaattcttatataggagctgggaagataaattcctagagatcctcactttcttaagtaggaaagcttattaggaatccaaatcttttgcctcatactggaagtaatgcaaagaagtagtctgatttttgagagggtgctgtttttctcaaatctagatcattacagagaaacagtgtacttttaacaactgttgcatgtgtaagaagactggtacatgatgccaatgaaattctttttttcctttaacttgggagctctcataccagttccgttgtacaaatgctgagattgtttcaaggttttattcctacagacatgttaggatttgtgtatcactgatttctccaataaaatttgaatatttcaggttatttcctttttcctaacttatgttagcattttgtatatatatatatatttgaattttggcttgtctggagtcttaaatatttggtatgccttcacatttggatttttagttttatttttacattgagacttctacctatatcattgactttattttttcctatgattaaaggattcagttatacaaaaagatgtttcagaaacactgctatttacctaaaggtaattttcagtttctttagaaggagttaggaaaatggtccttaatacctatatagggttttttaaaaaactgtaccctataatgcagccacagaagatctaaataataaacaattgcgcatactattaatatatatttagagcttttgttaagtacatgaaaagacagtattgcatagtggttaaatgcatggactctgaagccatcctgtttgggatcatcctggctacattgcttactagctgtgtgacaatggatataggtgcttaatgtctctgtgcctcagtttttgtgtctatgtaaaggagataataggatccccctcatgcctcatggtcttagttgaatgaattcatgtaactccacaggtatcttaatccagaaggctcaaaatactaatgttttgtgtgtgtgtgtgtgtgtgcatgtgcatctgtatgacaagtgatataaaacgtgacctgaatttataatatgaatagtcacattttgcagcagaaatattaaatgtttaattatagaatgctagcactgatcctgctgaaattgttacaaaatacagcagttgccccttaactgtggcagatacattccaagacccccagtactgaatgctgtatgtacattttttatacatgtatacttatgataaagtttataaattaggcacagtaagatattaataatagaatatacaatataccgcaataaaacttatgtgaacagttatttttggacagcagttgactgtgggtcactgaaattgtggaaagcaaaaccatggataaaggggaactattaatagtctatctgtattgcattatcttctaaaatccaaaattctgacttcaaaaactcatctgagggttttggaattgtgtatctatgtgtgtgaagtgcaaagagcagtgcttcatgtgacagataacatcagatgatcctaggctggaaggtggaaatcctagagaagatttttttgtgttgtaagttcagtctttcaagatgtggaattctgtctgaggaaagtatatcacctagttaacaattgttactgtaatttataaaatttgtactttggagagcataagaattcatgaaaagtttttaataattttacttaaacagagcttaattatgtaagtattgtcagcactttataaagaatcgtaaaataaaatagtggcagaaaatataaactagatgtagaatgttaaggaactttcggaagttctctggttttcatttcaatttcaaagctcaaaacagaaggtaaaactattaggatttgtgaaaaatacaaggtacaaaatcacgcagtttataaaccacagattgtcttgttattcccatcagtgaaaagaagctgatatttgtttgtgtttgtttttgtttttgtttttgagacggagtcttgctctgtcgcccaggctggagtgcagtggcgccattttggctcactgcaagctccgcctcccggttcacgccattctcatgcctcagcctcccaagtagctgggactacaggcgtccgccaccatgcccggctaattttttgtatttttagtagagacaagagtttcaccgtgttagccaggatggtctcatctcctgatcttgtgacccgcccgcctcggcctcccaaagtgctgggattacaggcgtgagccaccatgcccagcctgctggtagatgtttttatgagttaattcatcaatcttattattcttgccccaaatgaatcagtgtggagcatatacaagtgtgtagacattaatatgggctcactgtcagctgggagttctcacaactaccactttttactgattatctgttttctaaactttttctgtggcttgaagtgactgaaagtgaacacattcataagtaatgagcttaggctgaggatatatatccagtgggggatgaaacatgcttaagaaattgagtgcatttcctttattattgttattattttgctatttcaaaacaattgactttaaaaaattatacttcaccacagagacaggtgttgttttgtaatggaaggagtagtaacttatgaatctagactcttaaaatcccagttctgatactttcataattgtgtgttttgagggcaagtgacttatctgaacttttttcttttttataacactggatgataattaaccctcaggattgtgaggatttaataactaagtcctgactcaaattatgttaccaataaatgctacttaaatgtaaagtccttgatttattttttcccctcagtcctgtttagtgttgaaattcttcaaaggagggtgagtctggcatttacctgctattcaagagttttcagaattcaaccccagccaaaatttttggccacatctcttgtcactgctttgctgtgtactaaagctcccagacacacaagaatcttctagtcatggtcaaactttttctgcaaagggcacttacagtctattgcatattctttgtttttagtgttcagacatctgctgtttctgaatatgtcgtgtattttcattcctttttctgcccctcctgggcatctccagtttcctactgatgtgtcaaaactgagtttgtatgctacctccaggaaagcagtctaatcttttgcaactctgttactgacttttgtggcattggattgggttatttgcttatggttgagacatcactggatcctttgatggagtcataccaaaaccacaacatgtcatgagcatgcttgagagtgctaatctattccttgtttgtcagaccagtacattacagttggttcatttcttcccccgtgtgactgagtttcttgagggcgcggtctagcttccatctttgtatgtgtagcacctggtacatagagaacaggctcccagaattggatggatttgctcatggtcttatcactgcacagaatgcccttattttcttccattcattctatgagatctcaattaaaatgtcagtactcttgtggaactcccctctccatgccctctactgaaatgcattgccactctagttgtgatgtgggagtgccttgtttatgcctctatttatgacaccttcatggtgtcacatgttatagggttagttgcggctgtgtctgttttaccttgtgtgtcttggtcagttagtgttatttacttaagctttggatctttgatacatagcgtagtgcctttcacatagtatgtactcaaatattggaagttactcatcccaaaccatagtgtttaaaattggggttttttaaaaatgtcaagcccttaaagttgatcatttatttgtcaatgtaaatagaatagtaatttgttttcaaaaagatgaggtcttgctgtggtgctcaggctggagtgcagtggctgttcacaggcgtgataattgtgtgttacagcctcaaagtccagggctcgagtgatcttctcacttcagcctcctgagtagctgagactaggcgtgcaccaccgtttctgacaggattttaatttttaagtaggtttttaacccacagccacgagagctaattttaactacattgttagaggtagtaacagttatataactaatcaaaaccagtgtgatatccaagtacttttttttttttttttttttgctatttaattttgagataccattttttggaggggtgtcctgatttattttatttattttatttatttatttttattttttatttttttagataaggtcttgctcttgcccaggctggaatgtaatggcatggtcgcagctcactgcagcctccgtcttctgggctcaagcaatcctccttcctcagcctcctgagtagctgggactacaggtgtgtgccaccactcccagctaatttttaaattttgtgtagagatggggtctccctgcattgcccaggttggtctctcaaactcctgggttcaagcagtcctcccaccttggcctcccaaagtgttgggattataggcgtaagccactgtgcccggctgttttttgttttgttttgttttgtgttttaattgaacggactgaagtttactttctaactaggttagccctccattcatacaaaattatgagcccaaatgtcttggggagagtacaggagaggccagatcttaaaagccaggagtggaattaggtttgagcatatgtagcaatatggaaacaaagagtgagtcaatttataagcataccaatcttcttggagacaaaagtttgaattgctcacgtgtccattttttttctggaatccctgaagaaattttgagatactgagtactagaaaaccctctttgatgagggttgtatactttatttttaaacagtatcaacaccgttgaggcccttcaagtctttgcagtcaaaagccatacactttttctttgagtgagcctttactttaaggtatgtagtagaataatataggtatctgaaaaagaacttggttcatgacatccactcattcatttatgcacttagcaaatattcattgattgccaaatacgcatcagacactgagctaggtgctaggtactaggtaaacaaaattccctgccttcatggagcttagcttgtggtggtggaaagaagccctcagcctgaatactcaacttatgtctgccgtttattccttaacacattaaactataggtaatagcatatgttagtctaatctttgtttagcaaagctatttcttgttctggaatataagtacagttacagcagaataagtaccaaggcaagattggagaatgaccggttgtgaacagggacttaggaatatgtgtagcataggattttattttagagttgttaaaatcagatcaacagagcatgtttttatgggccatctgacaagactagaggtagctttggaacctcttattccctggaatgcaaacatgtatttgcatttcatccactgtcagtatgaggagacaaaaacgaagtcaggattttggagctggaatggatcttaaatactatgtagtccaaacgtttggttttacagatgcactttttccagagtgctgtcatctcatatacttttttcttcatacaggtttttaatgtaactcactcagatcgttggtgatagactctctcttaaaacttatttatcctaatcttttttttttttttttttttaagagacagggttttgctctgctgtccaggcacacaatagctcactgtaacctccaactcctggagtcaagtgatcctcctgcctcagcctctcaggtagctgggactgcactactagtgcactaagctaatttttaaattttttttgtagagacagggtcttgctgtgttgcccgggctgctctcttaactcctggcctcaagtaatcctcttgccttggcttcccaaagtgctgggattacaggcgtgagccaccatgcttagctgatttgccctaatcctctgctgacattctgatatcggacaactaaaattataacattgggcagctattttgtatgatatatagggtagtggttcttaagcttattggtgagtaaccttcacttgggaagcttatttttaaaaatgtagaccttcattactttcctcctgagattttgaatcagtacctttgagagagggtccagtaaatctttgttttgaatgaactgatggttttgaagcaggtgacctggaggactgcatgtagaacacagtgatgtcaaggagtaaaggagagaacagaagtgagattagcactaatcacctctaatgccttatttccagtaaagtttagagaagaggaaaagctacttggcttgctcctttgaaggttttgtttccctcttaacacagaaattaaaaggtagaggagagatgctgaatgatgctttttttcttcttaatcttggggggtcattatgattaagttattgaatccatatcaccgtatgacagcacatgatgaaagaaaatcaaatgtttgtttcaatcaaagtgaaacaaaatgagaataactatttgggcaaaacacttttatcactgctaagatattactagaactgagcagagaaatactcagagagagccatggcatagtactaattaataatggggtaccatttagcaactggaatattctccgatgatgcctgtttaattacccataggtgctaagtgaatgttaaaaattacggtgctggttgagtaggccgagtagaatttgtgttagggcacatcccatggagatcttttttactgcttaattttttggagttacctcagtaacttaacaggcaggaatatggttttaatggaaaggaaaccatttgcctttaacagcattagtcccgctaagagaaagtttttgcttgtctagtttattacaggtctttgactttgtcagtatatggcaaatttagtataaaagatgattaattatcaaggctgatgaaatataggcagctgaaaagaaaattcttagcaattcataccttagaaggaaccctgaaggacaggacgccatagaaatcctgtttttttaaaaaagtaatttcaagtaagtttgcaaatgcaatgctagtaaaaagtatatagaggtatgtctttcacactatcttgttactattagaatttttgtagccatgtgcagaggagagaaaaggtgttggattttctgcagttctgattcagttctaagaatttggtgtgaaaagaatgtttgcaaaggagcaggcacaaaggtgagaacaggaatacgaaacacaacatctgtaaatgactaaattcagagggaatttagtggggcatatctcttaaatggttttgaataatttggtgttttaaccaatgacttaatttaacttagtgggtatactgttcccagtcccattactgatttttattcctctgtgataacatacacccaaataaagactgctatgtatttgactttaaaactataaagatgtaaaaaaggttcactaagccaaacaccttagaaaatagcctcagctatttgctatgtttatattatacctgcataaaagtatttatgtatagatgtacttaccttacacagtaagtacctaaaatttgtaaattgaatacttttgaatgtaagcagttgaagtaaaacctgtagtgagttcttcagtcagtcaacactaaacctgttttgtaaatttgatgctagtattatactggactttctcaaaatgaagtacacctatatatgcatatagtatatgagcatgtgtatttgtacaaaagcccttcaaaaggagttcagcttttataaacaccaaaacactctctgcctgtaaaatgtttttgctgaaatttgtatcattaactctcaaatttacatcttcatgtttgagatacgcttttaggactgtctatgcatgtagactttggtcaactctctcctcctccctcaataaatcagttaacttaaaaaatatattgtgaccatttttataaaatacatgttcataaaacagatcaacatatttagcttatacagaaataaaattaagtcaatccactcacaaagaatttctattttgtaaaaatgtagcttgtatttcagtataataaaatctgatgtaagaaa

SEQ ID NO: 180928 - DNA, 1217 bp, Homo sapiens
  Payload ID: 15628
  Gene Symbol: SUGT1
  Gene Name: SGT1 homolog, MIS12 kinetochore complex assembly cochaperone
  Uniprot ID: Q9Y2Z0
  ENST ID: ENST00000343788
  CDS Start-End: 83-1180
cagaagtttcccccttgggcggtggtggaggtggtaaccgtgatagtagcagctccggcggcagcaacagcgactacgagggatggcggcggctgcagcaggaactgcaacatcccagaggtttttccagagcttctcggatgccctaatcgacgaggacccccaggcggcgttagaggagctgactaaggctttggaacagaaaccagatgatgcacagtattattgtcaaagagcttattgtcacattcttcttgggaattactgtgttgctgttgctgatgcaaagaagtctctagaactcaatccaaataattccactgctatgctgagaaaaggaatatgtgaataccatgaaaaaaactatgctgctgccctagaaacttttacagaaggacaaaaattagatatagagacggggtttcatcgtgttggccaggctggtctccaactcttgacctcaagtgatccacctgccttggactcccaaagtgctgggattacaggtgcagatgctaatttcagtgtctggattaaaaggtgtcaagaagctcagaatggctcagaatctgaggtgtggactcatcagtcaaaaatcaagtatgactggtatcaaacagaatctcaagtagtcattacacttatgatcaagaatgttcagaagaatgatgtaaatgtggaattttcagaaaaagagttgtctgctttggttaaacttccttctggagaggattacaatttgaaactggaacttcttcatcctataataccagaacagagcacgtttaaagtactttcaacaaagattgaaattaaactgaaaaagccagaggctgtgagatgggaaaagctagaggggcaaggagatgtgcctacgccaaaacaattcgtagcagatgtaaagaacctatatccatcatcatctccttatacaagaaattgggataaattggttggtgagatcaaagaagaagaaaagaatgaaaagttggagggagatgcagctttaaacagattatttcagcagatctattcagatggttctgatgaagtgaaacgtgccatgaacaaatcctttatggagtcgggtggtacagttttgagtaccaactggtctgatgtaggtaaaaggaaagttgaaatcaatcctcctgatgatatggaatggaaaaagtactaaataaattaatttgctctcatcgtattgtgtatattca

SEQ ID NO: 180929 - DNA, 593 bp, Homo sapiens
  Payload ID: 15629
  Gene Symbol: SH2D1A
  Gene Name: SH2 domain containing 1A
  Uniprot ID: O60880
  ENST ID: ENST00000360027
  CDS Start-End: 119-496
ttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 180930 - DNA, 2450 bp, Homo sapiens
  Payload ID: 15629
  Gene Symbol: SH2D1A
  Gene Name: SH2 domain containing 1A
  Uniprot ID: O60880
  ENST ID: ENST00000371139
  CDS Start-End: 300-686
aaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacatctggctgaactgggagtcaggtggttgacttgtgcctggctgcagtagcagcggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggcgtgtactgcctatgtgtgctgtatcacggttacatttatacataccgagtgtcccagacagaaacaggttcttggagtgctgagacagcacctggggtacataaaagatatttccggaaaataaaaaatctcatttcagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgcatttctaaagccattgtagtcctgtaatggaagcatctagcatgtcgtcaaagctgaaatggacttttgtacatagtgaggagctttgaaacgaggattgggaaaaagtaattccgtaggttattttcagttattatatttacaaatgggaaacaaaaggataatgaatactttataaaggattaatgtcaattcttgccaaatataaataaaaataatcctcagtttttgtgaaaagctccatttttagtgaaatattattttatagctactaattttaaaatgtcttgcttgattgtatggtgggaagttggctggtgtcccttgtctttgccaagttctccactagctatggtgtcataggctcttttgggatttttgaagctgtatactgtgtgctaaaacaagcactaaacaaagagtgaaggatttatgtttaattctgaaagcaaccttcttgcctagtgttctgatattggacagtaaaatccacagaccaacctggagttgaaaatcttataatttaaaatatgctctaaacatgtttatcgtatttgatgctacaggatttgaaattgtattacaaatccaatgaaatgagtttttcttttcatttacctctgccccagttgtttctactacatggaagacctcattttgaagggaaatttcagcagctgcagctcatgagtaactgatttgtaacaagcctccttttaaagtaaccctacaaaaccactggaaagtttatggttgtattattttttaaaaaaattccaagtgattgaaacctacacgagatacagaattttatgcggcattttcttctcacatttatatttttgtgattttgtgattgattatatgtcactttgctacagggctcacagaattcattcactcaacaaacataatagggcgctgagggcatagaagtaaaaacacctggtccctgctctcagttcactgtcttgttggacgagaaaacaataacgataaaagacagtgaaagaaaataacgataaaagacagtgaaagaaaataacaataaaagacaaggaaaaaataacaatgaaagttgataagtacatgataagcgaggttccccgtgtgtaggtagatctggtctttagaggcagatagataggtcagtgcaaatactctggtccatgggccatatgaaaaggctaagcttcactgtaaaataataactgggaattctggattgtgtatgggtgttggtgaacttggttttaattagtgaactgctgagagacagagctattctccatgtactggcaagacctgatttctgagcatttaatatggatgccgtgggagtacaaaagtggagtgtggcctgagtaatgcattatgggtggtttaccatttcttgaggtaaaagcatcacatgaacttgtaaaggaatttaaaaatcctactttcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaaataaagtgtttgaaagctttattta

SEQ ID NO: 180931 - DNA, 461 bp, Homo sapiens
  Payload ID: 15629
  Gene Symbol: SH2D1A
  Gene Name: SH2 domain containing 1A
  Uniprot ID: O60880
  ENST ID: ENST00000477673
  CDS Start-End: 55-285
ggcatctcccttgcacagttctcctcctcggcctgcccaagagtccaccaggccatggacgcagtggctgtgtatcatggcaaaatcagcagggaaaccggcgagaagctcctgcttgccactgggctggatggcagctatttgctgagggacagcgagagcgtgccaggtatcacggttacatttatacataccgagtgtcccagacagaaacaggttcttggagtgctgagcatttcagaagccagatcaaggcattgtaatacctctgcagtatccagttgagaagaagtcctcagctagaagtacacaaggtactacagggataagagaagatcctgatgtctgcctgaaagccccatgaagaaaaataaaacaccttgtactttattttctataatttaaatatatgctaagtcttatatattgtagataatacagttcggtgagctacaaatgca

SEQ ID NO: 180932 - DNA, 2523 bp, Homo sapiens
  Payload ID: 15630
  Gene Symbol: SH2D1B
  Gene Name: SH2 domain containing 1B
  Uniprot ID: O14796
  ENST ID: ENST00000367929
  CDS Start-End: 111-509
gtagctccacaggaggtacagctgcttacacatctctcctcagagctgtcccttgacttgggggtgaatttcaggccaacagggcttcctgggatacaagagcgttctccatggatctgccttactaccatggacgtctgaccaagcaagactgtgagaccttgctgctcaaggaaggggtggatggcaactttcttttaagagacagcgagtcgataccaggagtcctgtgcctctgtgtctcgtttaaaaatattgtctacacataccgaatcttcagagagaaacacgggtattacaggatacagactgcagaaggttctccaaaacaggtctttccaagcctaaaggaactgatctccaaatttgaaaaaccaaatcaggggatggtggttcaccttttaaagccaataaagagaaccagccccagcttgagatggagaggattgaaattagagttggaaacatttgtgaacagtaacagcgattatgtggatgtcttgccttgaagataaggctgccggacaaagcaagttgaagagatgagtaacagttctcactgatgacccacttctgcaggcataggtccagagcaccaaactctagtggacaattcagactctcctggttgtgtaactgaagatgttctgcccaccagcaccagaggtcactctccacatccccgcctcccagacatataccaggagcaatttcaaaaccctctccagtttcactcttctttcttggaatgggacagcctgaacattttccctttgacttgttaaaggtaccaccctacatcatggttgacaccctcctttggaccatgcagtcagaggggcagctttatacagaggaggggcacacttgtctgtgagtttgaagccctgagttccagtcctgtggctgtgtgactttgaacacgtttctgcccatctccaggtcttagtttctttgtctctgtggttgggtgggatgataaacattgccccagtctctctgttgagcctgcttgtgtcaggtgaaggtgagggatcgggagtgatggagatgcatacagatcagcaccttctctgtacctgctggacccccatgtgcacccttctccctccagcctgggctactctcctcctggttctttctaatcttaaacttcctggtgagcattgccccagccacactttctccctggttttgcttaattccacttatgcatcagtcatttcaacagcatgaatgtggttctgtacagtgatgtatgtggagatttctaaaatattctatgtgtgatttctgttcccaactaggttctaagtgccatcaaagcacggttgggtctcccttgtatcttccacagtgtgtagaaatttgtgctgcccagagctgtgcctagttcatagaaactgactggaagcacattgctgagggaggtttgttgaattggtttttaaggtttactgaaattgatttgctgaatttttctgctagttcaaaatgtgaattaggacctggtcagtttgaaatataccaaattctatgccctttctcttacctatcatcaaattgtagtaatgtatttcaccccactggacttatcttcagagttttaaaagagaggagctctcgacttagaggtaatatgaacagatgaacagacactgtggctggagccccaaagtgtggagcattgtgagatttggggtcacagcaatttatggctactattccctgggtctggtaggtaggacaaatgtcctcttttacttttcaaaactggcttaggtattcatggaccttgattcttctatatacattttataataaatacgtgaaattgcttaaaacctctttttggaatttttaatgaacttgcaacaaatttgtaaataggagagaactgacgttcttgtgatgttttcccatgcataaacatgccacatccatgttcttgggtcatcttttttgccctttcatggagtcataaattttcccaactgaagtcttgtatattctgttagattaattcctatttctagttgctgtaaatgatatcttatgttttattacatttctaataggatatggtgttggtgaaatgttaaccctctcattagatctactagtttacctgttgattctattgtgttttctatgtaaatgattttgtcagctataaataataacattttattttctctttccttgcaatacctatgctcatttattttttatgtttacccattggttagggcctcctgtatacattaaacagttcatagtcatgatagtgagtattcttacactgttcccagtattacagggaatgcttagaaattttctttatttaaacattatgtttgttgtagccttgttaaaggctattttataatttttactagaaatattttgacatttattgtgatttttttctatctctaatctattgagatagtcacattccttttgtcttcactccattataaaggtaagttaccttaataaaattgttgatatcatttcatc

SEQ ID NO: 180933 - DNA, 1599 bp, Homo sapiens
  Payload ID: 15631
  Gene Symbol: SH2D2A
  Gene Name: SH2 domain containing 2A
  Uniprot ID: Q9NP31
  ENST ID: ENST00000368198
  CDS Start-End: 150-1265
gggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggga

SEQ ID NO: 180934 - DNA, 1658 bp, Homo sapiens
  Payload ID: 15631
  Gene Symbol: SH2D2A
  Gene Name: SH2 domain containing 2A
  Uniprot ID: Q9NP31
  ENST ID: ENST00000368199
  CDS Start-End: 155-1324
cgtgagtcctcgccagaactaaggctgtgggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggga

SEQ ID NO: 180935 - DNA, 1673 bp, Homo sapiens
  Payload ID: 15631
  Gene Symbol: SH2D2A
  Gene Name: SH2 domain containing 2A
  Uniprot ID: Q9NP31
  ENST ID: ENST00000392306
  CDS Start-End: 141-1340
agaactaaggctgtgggtaaggcgacatttcctgcccccggggccagggtgagaggagagatgatgagttgctgagtgtgcacacctttccggaacacatacacacaccctgctctgggatcccttgtgaggctgccctcatggagttccccctggcccagatatgtccccaagggagtcacgaagcccccatcccaaccttcagcaccttccagatcacagacatgacccgcaggagctgccagaacctgggctacactgcggcatctccccaggccccggaggctgcctccaacacagggaatgctgagagggcagaggaggtgcctggagaaggaagcctgttcctgcaggccgagacccgggcttggttccagaagacccaggcccactggctcctgcagcacggggcagcccctgcctggttccatggcttcatcacccggagggttcggccccctctctccgtcacccacagggaggcagagaggctgctggagcccaagcctcaggggtgctacttggtgcggttcagcgagagcgcggtgaccttcgtgctgacttacaggagccggacttgctgccgccacttcctgctggcccagctcagggacgggcgccacgtggtgctgggcgaggacagcgcccacgcgcggctgcaggacctgctgctgcactacaccgcgcacccgctcagcccctacggggagacgctcaccgagcccctcgcccgacagactcctgagcctgcaggactttccctgaggaccgaagaatcaaactttggaagcaaaagccaggacccaaacccccagtacagcccaatcatcaaacaggggcaagccccagtcccgatgcagaaagagggggccggggagaaggagccctcccagctgctcaggcccaagcctcccatccccgccaaacctcagctgcccccagaagtctacacaatccctgttccacgacaccgcccggccccacgccccaagccctccaatcctatctacaatgagcctgatgaacccatagctttctatgccatgggccggggcagccctggggaagcccccagcaacatctatgtggaagtggaagatgagggcctacccgccacccttgggcaccctgtcctacggaagagctggtccaggcctgtcccaggaggccagaatacaggtggctcccagctgcattctgagaactctgtgattgggcaaggccctcccctgccccaccagcccccacccgcctggagacacaccctcccccacaatctttctagacaggtgcttcaggacagaggacaggcatggcttccccttgggcctcctcagtaggcggtctggcctgacccccaacaaagaagcctggaggtcagagaagcaaatgcggagcctgctccctcctaagaagatcccaagaatccaatggctcagtccttggtgatctaagacagcaaagaagtgtgcaaggagggccctgttagctcccactgtcctggtttctcctcctggagtctaatttccttggccctctgagccttttgagtctgggccctggtccaatgctgctgttgtctgaggaatggtttggtgagaacagatgttagaacttgtttgttgattcttgtctggctaataaatcatcaccaactgccttctcctacaggg

SEQ ID NO: 180936 - DNA, 2296 bp, Homo sapiens
  Payload ID: 15632
  Gene Symbol: SH2D3A
  Gene Name: SH2 domain containing 3A
  Uniprot ID: Q9BRG2
  ENST ID: ENST00000245908
  CDS Start-End: 271-2001
aagttagtttgaggcggggcccgcagggggcggggtctgcaggaggtgtggtcaggtaactgggctgagttcccactaggtgtggtctgggaaggctggggcggtggcaaggtggagggcgggggtgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctca

SEQ ID NO: 180937 - DNA, 2013 bp, Homo sapiens
  Payload ID: 15632
  Gene Symbol: SH2D3A
  Gene Name: SH2 domain containing 3A
  Uniprot ID: Q9BRG2
  ENST ID: ENST00000437152
  CDS Start-End: 134-1585
agcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggttcgtggggagcagggactggaggaagctggagtgcgggtgactgggaagactggagaggaggcgtgctcagatctcttctcccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatg

SEQ ID NO: 180938 - DNA, 859 bp, Homo sapiens
  Payload ID: 15632
  Gene Symbol: SH2D3A
  Gene Name: SH2 domain containing 3A
  ENST ID: ENST00000597687
  CDS Start-End: 146-859
tgacagcagcccggagccgcggagcctcagcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagag

SEQ ID NO: 180939 - DNA, 3124 bp, Homo sapiens
  Payload ID: 15633
  Gene Symbol: SH2D3C
  Gene Name: SH2 domain containing 3C
  Uniprot ID: Q8N5H7
  ENST ID: ENST00000314830
  CDS Start-End: 115-2697
ggaagcgagtaagagaaaggggaaggggaggtgggagaggcacctcaactttgatgtcccgagccttgagtggccactcgcaagctggccaagggcttcacacaatttgccaagatgacagaggggaccaagaagaccagcaaaaagttcaagttcttcaagttcaagggctttgggagtctctccaacctccctcggtccttcactctgagacgatcctcagcttccatcagtaggcagtcccatttggagcctgacacctttgaagccacgcaggatgacatggtgacggtgcccaagagtcccccagcctatgcccgctccagtgacatgtacagccacatgggcaccatgcctcgccccagcatcaagaaagcacagaactcacaggctgcccggcaggcccaggaggcgggtcccaagcccaacttggtacccggaggtgtacccgaccccccaggcttggaggcagccaaagaggtgatggtgaaggccactggccctctagaggacaccccagcaatggaacccaacccttcagcagtggaggtagaccccatcagaaagcctgaggtccccacaggagacgtagaagaggagagacctcccagggacgtgcactcagaaagggctgctggagagccagaggctggcagcgactatgtgaagttctccaaggagaagtacatcctggactcatcgccagagaaactccacaaggaattggaggaggagctcaaactcagcagcacggatctccgcagccatgcctggtaccatggccgcatcccccgagaggtctcggagaccttggtacaacgcaacggcgacttcctcatccgggactcactcaccagcctgggcgactatgtgctcacgtgccgctggcgcaaccaggccttgcacttcaagatcaacaaggtggtggtgaaggcaggcgagagctacacacacatccagtacctgtttgagcaggagagctttgaccacgtgcccgccctcgtgcgctatcatgtgggcagccgcaaggctgtgtcagagcagagtggtgccatcatctactgcccggtgaaccgcaccttcccactgcgctacctcgaggccagctatggcctgggacaggggagtagcaagcctgctagccccgtcagcccctcaggccccaagggcagccacatgaagcggcgcagcgtcaccatgaccgatgggctcactgctgacaaggtcacccgcagcgatggctgccccaccagtacgtcgctgccccgccctcgggactccatccgcagctgtgccctcagcatggaccagatcccagacctgcactcacccatgtcgcccatctccgagagccctagctcccctgcctacagcactgtaacccgtgtccatgccgcccctgcagccccttctgccacagcattgcctgcctcccctgtcgcccgccgttccagtgagccccagctgtgtcccggaagtgccccaaagacccatggggagtcagacaagggcccccacaccagcccctcccacacccttggcaaggcctccccgtcaccatcactcagcagctacagtgacccggactctggccactactgccagctccagcctcccgtgcgtggcagccgagagtgggcagcgactgagacctccagccagcaggccaggagctatggggagaggctaaaggaactgtcagaaaatggggcccctgaaggggactggggcaagaccttcacagtccccatcgtggaagtcacttcttccttcaacccggccaccttccagtcactactgatccccagggataaccggccactggaggtgggccttctgcgcaaggtcaaggagctgctggcagaagtggatgcccggacgctggcccggcatgtcaccaaggtggactgcctggttgctaggatactgggcgttaccaaggagatgcagaccctaatgggagtccgctggggcatggaactgctcaccctcccccatggccggcagctacgcctagacctgctggaaaggttccacaccatgtccatcatgctggccgtggacatcctgggctgcaccggctctgcggaggagcgggcagcgctgctgcacaagaccattcagctggcggccgagctgcgggggactatgggcaacatgttcagcttcgcggcggtcatgggtgccctggacatggcccagatttctcggctggagcagacatgggtgaccctgcggcagcgacacacagagggtgccatcctgtacgagaagaagctcaagccttttctcaagagcctcaacgagggcaaagaaggcccgccgctgagcaacaccacgtttcctcatgtgctgcccctcatcaccctgctggagtgtgactcggccccaccagagggccctgagccctggggcagcacggagcacggcgtggaggtggtgctggctcacctggaggccgcccgcacagtggcacaccacggaggcctgtaccacaccaatgctgaagtcaagctgcaggggttccaggcccggccggagctcctggaggtgttcagcacggagttccagatgcgccttctctggggcagtcagggtgccagcagcagccaggcccggcgctatgagaagttcgacaaggtcctcactgccctgtcccacaagctggaacctgctgtccgctccagcgagctgtgaccccagggacatttcccctctgcagctgcggacagcgtcaggggcagaggggcacacaactttccccagagcaccccaaggacactgtgatcaacccgagaatgttctgggttcaactcaagcatctcccttgcacctccagggtcctgcgtggactctgggttccatcccacctgctacatgctcaccaggtctccattgaggaagaacaggaacgccggttcccccaccagcttttgctgctccccttcctgctggggttccctgttttcgagccatgggaggcaggctgctcacgcctcctcactctctgtctgtccctcaccaacaccaaggcctccatctcactgtaaataagtctctgttctgtaaatagatgtacagaagccatgttatttctttcatataataaacttttatgactctt
